(12) United States Patent
Cohen et al.

(10) Patent No.: US 6,555,316 B1
(45) Date of Patent: Apr. 29, 2003

(54) SCHIZOPHRENIA ASSOCIATED GENE, PROTEINS AND BIALLELIC MARKERS

(75) Inventors: Daniel Cohen, Neuilly-sur-Seine (FR); Marta Blumenfeld, Paris (FR); Ilya Chumakov, Vaux-le-Penil (FR); Lydie Bougueleret, Petit Lancy (CH); Laurent Essioux, Paris (FR)

(73) Assignee: Genset S.A. (FR)

( * ) Notice: Subject to any disclaimer, the term of this patent is extended or adjusted under 35 U.S.C. 154(b) by 0 days.

(21) Appl. No.: 09/679,409

(22) Filed: Oct. 3, 2000

Related U.S. Application Data

(63) Continuation-in-part of application No. 09/539,333, filed on Mar. 30, 2000, now Pat. No. 6,476,208, and a continuation-in-part of application No. 09/416,384, filed on Oct. 12, 1999.
(60) Provisional application No. 60/168,088, filed on Nov. 30, 1999.

(51) Int. Cl.[7] .......................... C12Q 1/68; C12P 19/34; C07H 21/02
(52) U.S. Cl. ..................... 435/6; 435/91.2; 536/23.1; 536/24.3; 536/24.31; 536/24.33
(58) Field of Search ................... 435/6, 91.2; 536/23.1, 536/24.3, 24.31, 24.33

(56) References Cited

FOREIGN PATENT DOCUMENTS

| WO | WO 97/27284 A2 | 7/1997 |
| WO | WO 98/11222 A1 | 3/1998 |
| WO | WO 98/20165 A2 | 5/1998 |
| WO | WO 00/22122 A2 | 4/2000 |

OTHER PUBLICATIONS

Wright et al, "Schizophrenia and HLA: A review", Schizophrenia Research 47(1):1–12 (2001).*
Database TrEMBL, Accession No. 002586; Liu, et al.; "Molecular cloning and expression of the gene encoding a cysteine proteinase of Spirometra erinacei".
Database Swissprot, Accession No. P12410; McCarn, et al.; "Genes encoding the alpha, gamma, delta, and four F0 subunits of ATP synthase constitute an operon in the cyanobacterium Anabaena sp. strain PCC 7120".
Database Geneseq, Accsession No. V76530; Barash, et al.; "Polynucleotide(s) and proteins derived from Staphylococcus aureus—stored on computer readable mediuma nd used in the production of anti–S.aureus vaccines".
Database Emest, Accession No. AA388085; Marra, et al.; "The WashU–HHMI Mouse EST Project".
Antonarakis, et al.; "Linkage and sib–pair analysis reveal a potential schizophrenia susceptibility gene on chromosome 13q32"; Am. J. Hum. Genet.; vol. 59; A210 (1996).
Lin, et al.; "Suggestive evidence for linkage of schizophrenia to markers on chromosome 13q14.1–q32"; Psychiatric Genetics; vol. 5 (1995); pp. 117–126; XP–000944456; Rapid Science Publishers.
Inayama, et al.; "Positive Association Between a DNA Sequence Variant in the Serotonin 2A Receptor Gene and Schizophrenia"; American Journal of Medical Genetics (Neuropsychiatric Genetics), vol. 67; pp. 103–105 (1996); Wiley–Liss, Inc.; XP–000944353.
Zhang, et al.; "Identification of protein coding regions in the human genome by quadratic discriminant analysis"; Proc. Natl. Acad. Sci. USA; vol. 94, pp. 565–568; Jan. 1997; Genetics' PNAS; 0027–8424/97/94565–4.
Chee, et al.; "Accessing Genetic Information with High–Density DNA Arrays", Science, vol. 94; pp. 60–614; XP002022508.
Database EMBL, Accession No. AC008024; Birren, et al.; "Homo Sapiens chromosome, clone RP11–4584".
Detera–Wadleigh, et al.; "A high–density genome scan detects evidence for a bipolar–disorder susceptibility locus on 13q32 and other potential loci on 1q32 and 18p11.2"; Proc. Natl. Acad. Sci. USA; vol. 96, pp. 5604–5609, May 1999; Genetics; PNAS.
Lin, et al.; "Suggestive evidence for linkage of schizophrenia to markers on chromosone 13 in Caucasian but not Oriental populations"; Hum. Genet. (1997); pp. 417–420; vol. 99; Springer–Verlag 1997.
Brzustowicz, et al.; "Linkage of Familial Schizophrenia to Chromosome 13q32"; Am. J. Hum. Genet., 1999, pp. 1096–1103; vol. 65; The American Society of Human Genetics.
Pulver, et al.; "The Johns Hopkins University Collaborative Schizophrenia Study: An Epidemiologic–Genetic Approach to Test the Heterogeneity Hypothesis and Identify Schizophrenia Susceptibility Genes"; Cold Spring Harbor Symposia on Quantitative Biology (1996); pp. 797–814; vol. LXI; Cold Spring Harbor Laboratory Press.
Straub, et al.; "Genome Scan for Schizophrenia Genes: A Detailed Progress Report in an Irish Cohort"; Am. J. Med. Genet. Neuropsychiatr. Genet. (1997); p. 558; vol. 74; Abstract.
Shaw, et al.; "A Genome–Wide Search for Schizophrenia Susceptibility Genes"; American Journal of Medical Genetics (Neuropsychiatric Genetics); 1998; pp. 364–376; vol. 81; Wiley–Liss, Inc.

(List continued on next page.)

Primary Examiner—Jeffrey Fredman
(74) Attorney, Agent, or Firm—Saliwanchik, Lloyd & Saliwanchik

(57) ABSTRACT

The invention concerns the human g35030 gene, polynucleotides, polypeptides biallelic markers, and human chromosome 13q31–q33 biallelic markers. The invention also concerns the association established between schizophrenia and bipolar disorder and the biallelic markers and the g35030 gene and nucleotide sequences. The invention provides means to identify compounds useful in the treatment of schizophrenia, bipolar disorder and related diseases, means to determine the predisposition of individuals to said disease as well as means for the disease diagnosis and prognosis.

40 Claims, 15 Drawing Sheets

OTHER PUBLICATIONS

Osoegawa, et al.; "A Bacterial Artificial Chromosome Library for Sequencing the Complete Human Genome"; Genome Research (2001); pp. 483–496; vol. 11; Cold Spring Harbor Laboratory Press.

RPCI—11 Human Male BAC Library; two pages http://www.chori.org/bacpac/hmale11.htm.

Leonid Kruglyak; "The Use of a Genetic Map of Biallelic Markers in Linkage Studies"; Nature Genetics, vol. 17, Sep. 1977; pp. 21–24; XP–002050647.

Blouin, et al.; "Schizophrenia susceptibility loci on chromosomes 13q32 and 8p21";Nature Genetics; vol. 20, Sep. 1998; pp. 70–73; XP–000944108.

Lander, et al.; "Genetic Dissectionof Complex Traits"; Science; vol. 265; Sep. 30, 1994; pp. 2037–2048.

* cited by examiner

Detailed haplotype analysis (case/controls: N=215/N=241)

| MARKERS | 99-16082/218 | 99-5862/167 | 99-16100/147 | 99-7652/162 | 99-5919/215 | 99-5897/143 | 99-16032/292 | 99-15880/162 | 99-16038/118 | 99-15875/165 | 99-16033/244 | 99-16047/115 | HAPLOTYPE DESCRIPTION | | | | |
|---|---|---|---|---|---|---|---|---|---|---|---|---|---|---|---|---|---|
| | | | | | | | | | | | | | Frequency [1] | | Statistics on a haplotype [2] | | |
| frequency in controls (Allele) | 32.14 (A) | 48.75 (T) | 49.56 (G) | 48.48 (G) | 60.17 (A) | 40.55 (C) | 57.5 (A) | 57.66 (A) | 57.74 (G) | 37.39 (T) | 46.71 (T) | 26.64 (T) | Cases | Controls | OR | | |
| diff (cases-controls) | 1.4 | 7.6 | 5.8 | 5.6 | 9.2 | 3.1 | 6.1 | 7 | 7 | 5.7 | 1.8 | 3 | | | | | |
| Single association (p-value) | 0.66 | 0.02 | 0.09 | 0.09 | 0.00355 | 0.34 | 0.06 | 0.03 | 0.03 | 0.08 | 0.58 | 0.32 | | | | | |
| | | ** | * | * | *** | * | | ** | ** | | | | | | | | |
| haplotype 1 | | | | | A | | | | | | | | 0.288 | 0.195 | 1.67 | 1.20E-03 | *** |
| haplotype 2 | | T | | | | | | | | | | | 0.238 | 0.155 | 1.71 | 1.70E-03 | *** |
| haplotype 3 | | | | G | | | | | | | | | 0.223 | 0.144 | 1.71 | 2.60E-03 | *** |
| haplotype 4 | A | | G | | | | | | | | | | 0.173 | 0.105 | 1.79 | 3.40E-03 | ** |
| haplotype 5 | | | | | | C | | | | | | | 0.231 | 0.159 | 1.59 | 7.70E-03 | ** |
| haplotype 6 | | | | | | | A | | | T | | | 0.306 | 0.228 | 1.49 | 8.60E-03 | ** |
| haplotype 7 | | | | | | | | A | | T | | | 0.305 | 0.229 | 1.48 | 9.60E-03 | ** |
| haplotype 8 | | | | | A | | A | | | | | | 0.4 | 0.319 | 1.42 | 1.00E-02 | ** |
| haplotype 67 | A | | | G | | | | | G | | | | 0.124 | 0.043 | 3.18 | 1.30E-05 | ***** |
| haplotype 68 | A | | | G | A | | A | | G | | | | 0.121 | 0.042 | 3.13 | 2.00E-05 | ***** |
| haplotype 69 | A | | G | | | | | | | | | | 0.13 | 0.048 | 2.96 | 2.60E-05 | ***** |
| haplotype 70 | | | | | A | A | | | | T | | | 0.188 | 0.091 | 2.32 | 2.90E-05 | **** |
| haplotype 71 | A | | A | | A | | | | | | | | 0.094 | 0.026 | 3.88 | 3.40E-05 | **** |
| haplotype 72 | A | | G | G | A | | A | | | | | | 0.127 | 0.047 | 2.92 | 3.70E-05 | **** |
| haplotype 73 | A | | | G | | | | A | | | | | 0.121 | 0.044 | 3.01 | 3.90E-05 | **** |
| haplotype 74 | A | | | | A | | | A | | | | | 0.128 | 0.049 | 2.85 | 4.90E-05 | **** |
| haplotype 75 | | | | | A | | | | | T | T | | 0.143 | 0.062 | 2.55 | 5.40E-05 | **** |
| haplotype 76 | | C | | | | | | | | | | | 0.098 | 0.033 | 3.15 | 1.00E-04 | **** |
| haplotype 287 | A | | G | G | | | | | G | | | | 0.138 | 0.038 | 4.01 | 3.10E-07 | ******* |
| haplotype 288 | A | | G | G | | | | | G | | | | 0.138 | 0.04 | 3.84 | 4.20E-07 | ****** |
| haplotype 289 | A | | G | | A | | A | | | | | | 0.135 | 0.038 | 3.94 | 5.40E-07 | ****** |
| haplotype 290 | | C | | | A | C | | | | | T | | 0.086 | 0.013 | 6.93 | 6.70E-07 | ****** |
| haplotype 291 | A | | G | | A | | A | | | | T | | 0.134 | 0.04 | 3.75 | 8.20E-07 | ****** |

°maxM : Table of haplotypes giving the Maximum positive difference between cases/controls.

1: Frequency of the haplotype leading to the maximum chi square test
2: Test on the frequency of this haplotype in cases vs in controls
3: p- value assuming that the test has a chi-square distribution with 1 degree of freedom

FIG. 3

Markers involved in selected haplotypes

| # of markers in the haplotype | Threshold of significance | # of haplotypes concerned | markers | | | | | | | | | | | |
|---|---|---|---|---|---|---|---|---|---|---|---|---|---|---|
| | | | 99-16082/218 | 99-5862/167 | 99-16100/147 | 99-7652/162 | 99-5919/215 | 99-5897/143 | 99-16032/292 | 99-15880/162 | 99-16038/118 | 99-15875/165 | 99-16033/244 | 99-16047/115 |
| 2-mks | <=10-2 | 7 | * | * | * | * | * | * | * | * | * | * | | |
| 3-mks | <=10-5 | 10 | * | * | * | * | * | * | * | * | * | * | * | |
| 4-mks | <=10-6 | 5 | * | * | * | * | * | * | * | | * | | * | * |

FIG. 4

SCHIZOPHRENIA STUDY

| MARKERS | | 99-24656/260 | 99-24639/163 | 99-24634/108 | 99-7652/162 | 99-16100/147 | 99-5862/167 | 99-5919/215 | 99-24658/410 | 99-24644/194 | 99-5897/143 | 99-24649/186 | 99-16038/118 | 99-15880/162 | 99-25940/182 | 99-16032/292 | 99-16033/244 | 99-15875/165 | 99-16047/115 | HAPLOTYPE DESCRIPTION | | | | HAPLOTYPE TEST BY PERMUTATION PROCEDURE | | |
|---|---|---|---|---|---|---|---|---|---|---|---|---|---|---|---|---|---|---|---|---|---|---|---|---|---|---|
| sample size (cases/controls) | | 134/136 | 137/137 | 138/135 | 140/140 | 133/135 | 141/141 | 141/141 | 140/140 | 139/137 | 140/140 | 140/139 | 141/141 | 141/140 | 140/135 | 141/141 | 135/132 | 140/138 | 138/135 | Frequency (1) | | Statistics on a haplotype (2) | | av.Chi2 | Max.Chi2 | # iter/obs |
| frequency in controls (Allele) | | 45.96 (G) | 59.49 (T) | 50 (T) | 49.64 (G) | 51.11 (G) | 50.71 (T) | 60.28 (A) | 61.07 (C) | 59.49 (G) | 38.93 (C) | 62.95 (C) | 56.38 (G) | 56.43 (A) | 52.59 (A) | 55.67 (A) | 43.56 (T) | 33.7 (T) | 24.81 (T) | Cases | Controls | OR | p-value (1df) (3) | | | |
| diff (cases-controls) | | 5.2 | 1.5 | 4.7 | 4.6 | 4.2 | 5.7 | 9.2 | 3.2 | 1.3 | 3.6 | 4.9 | 9.2 | 8.8 | 6.7 | 8.5 | 1.6 | 9.2 | 3.1 | | | | | | | |
| p-value | | 0.221 | 0.655 | 0.254 | 0.254 | 0.317 | 0.168 | 0.0213 | 0.403 | 0.752 | 0.371 | 0.221 | 0.0239 | 0.032 | 0.114 | 0.0381 | 0.655 | 0.0253 | 0.403 | | | | | | | |
| HW-test | cases | 0 (NS) | -0.007 (NS) | -0.009 (NS) | -0.023 (NS) | -0.005 (NS) | -0.013 (NS) | -0.029 (NS) | -0.013 (NS) | 0.012 (NS) | -0.023 (NS) | 0.011 (NS) | -0.019 (NS) | -0.021 (NS) | -0.016 (NS) | -0.029 (NS) | 0.025 (NS) | -0.012 (NS) | -0.013 (NS) | | | | | | | |
| | controls | 0.009 (NS) | -0.033 (NS) | -0.013 (NS) | -0.018 (NS) | -0.009 (NS) | -0.009 (NS) | -0.009 (NS) | -0.03 (NS) | -0.011 (NS) | 0.013 (NS) | -0.001 (NS) | 0.023 (NS) | 0.024 (NS) | 0.012 (NS) | 0.016 (NS) | -0.008 (NS) | 0.017 (NS) | 0.02 (NS) | | | | | | | |
| haplotype 1 | 140 vs 138 | | | | | | T | | | | | | | | | | | | | 0.257 | 0.125 | 2.41 | 7.80E-05 | 1.5 | 8.1 | 0/100 |
| haplotype 2 | 140 vs 138 | | | | | | | A | | | | | | | | | | | | 0.3 | 0.162 | 2.22 | 1.10E-04 | 1.5 | 9.4 | 0/100 |
| haplotype 3 | 139 vs 138 | | | | G | | | | | | | | | | | | | | | 0.243 | 0.119 | 2.38 | 1.50E-04 | 1.3 | 10.4 | 0/100 |
| haplotype 4 | 137 vs 133 | | | T | | | | | | | | | | | | | | | | 0.238 | 0.121 | 2.28 | 3.70E-04 | 1.1 | 10.2 | 0/100 |
| haplotype 5 | 132 vs 133 | | | | | G | | | | | | | | | | | | | | 0.246 | 0.132 | 2.14 | 8.20E-04 | 1.2 | 7.6 | 0/100 |
| haplotype 6 | 135 vs 132 | | | | | | | A | | | | | | | | | | | | 0.309 | 0.197 | 1.82 | 3.00E-03 | 1.3 | 8.5 | 0/100 |
| haplotype 8 | 140 vs 137 | | | | | | | | | | | | | A | | | | | | 0.296 | 0.196 | 1.72 | 6.50E-03 | 1.2 | 7.3 | 0/100 |
| haplotype 9 | 140 vs 138 | | | | | | | | | | | | G | | | | | | | 0.294 | 0.197 | 1.7 | 7.70E-03 | 1.3 | 8.3 | 0/100 |
| haplotype 154 | 138 vs 138 | | | | | | | | C | | | | | | | | | T | | 0.252 | 0.116 | 2.57 | 3.40E-05 | 1.2 | 7.2 | 0/100 |
| haplotype 155 | 139 vs 138 | | | | | | | | C | | | | | | | | | T | | 0.247 | 0.113 | 2.57 | 4.20E-05 | 1.1 | 9.1 | 0/100 |
| haplotype 156 | 137 vs 135 | | | | | | | A | | | | | | | | | | T | | 0.252 | 0.117 | 2.54 | 4.90E-05 | 1.4 | 12.6 | 0/100 |
| haplotype 157 | 139 vs 138 | | | | | | | A | | | | | | | | | | T | | 0.265 | 0.128 | 2.45 | 4.90E-05 | 1.6 | 19.5 | 1/100 |
| haplotype 158 | 136 vs 133 | | | T | | | | | C | | | | | | | | | | | 0.247 | 0.113 | 2.58 | 5.10E-05 | 1.1 | 6.8 | 0/100 |
| haplotype 159 | 132 vs 124 | | | T | | | | | C | | | | | | | | | | | 0.144 | 0.04 | 4 | 5.70E-05 | 1.4 | 11.5 | 0/100 |
| haplotype 160 | 135 vs 129 | | | | | | | | | | | | | | | | C | | | 0.153 | 0.048 | 3.57 | 6.70E-05 | 1.4 | 11.6 | 0/100 |
| haplotype 161 | 139 vs 138 | | | | G | | T | | | | | | | | | | | | | 0.245 | 0.118 | 2.43 | 1.00E-04 | 1.4 | 10.4 | 0/100 |
| haplotype 162 | 136 vs 133 | | | T | G | | | | | | | | | | | | | | | 0.244 | 0.116 | 2.47 | 1.00E-04 | 1.3 | 8.2 | 0/100 |
| haplotype 163 | 137 vs 137 | | T | | | | C | | | | | | | | | | | | | 0.075 | 0.009 | 8.8 | 1.10E-04 | 1.4 | 11.4 | 0/100 |
| haplotype 970 | 136 vs 132 | | | | | | | A | C | | | | | | | | | T | C | 0.199 | 0.056 | 4.17 | 7.80E-07 | 3.6 | 21 | 0/100 |
| haplotype 971 | 139 vs 138 | | | | | | | G | C | | | | G | | | A | | C | | 0.076 | 0 | 100 | 2.70E-06 | 2 | 12 | 0/100 |
| haplotype 972 | 139 vs 138 | | | | | | | G | C | | | | | A | | | | C | | 0.076 | 0 | 100 | 3.00E-06 | 2.1 | 15 | 0/100 |
| haplotype 973 | 139 vs 137 | | | | | | | G | C | | | | G | | | | | C | | 0.076 | 0 | 100 | 3.40E-06 | 1.9 | 12.1 | 0/100 |

BIPOLAR DISORDERS STUDY
HAPLO_MAXM TEST VALUES DISTRIBUTIONS

CAUCASIAN CASES (N=182) / CAUCASIAN CONTROLS (N=177)

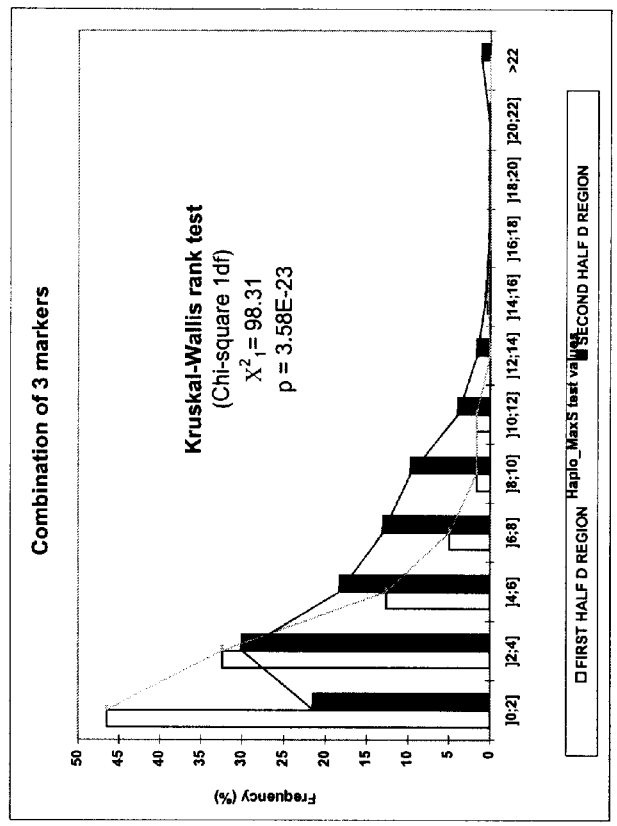
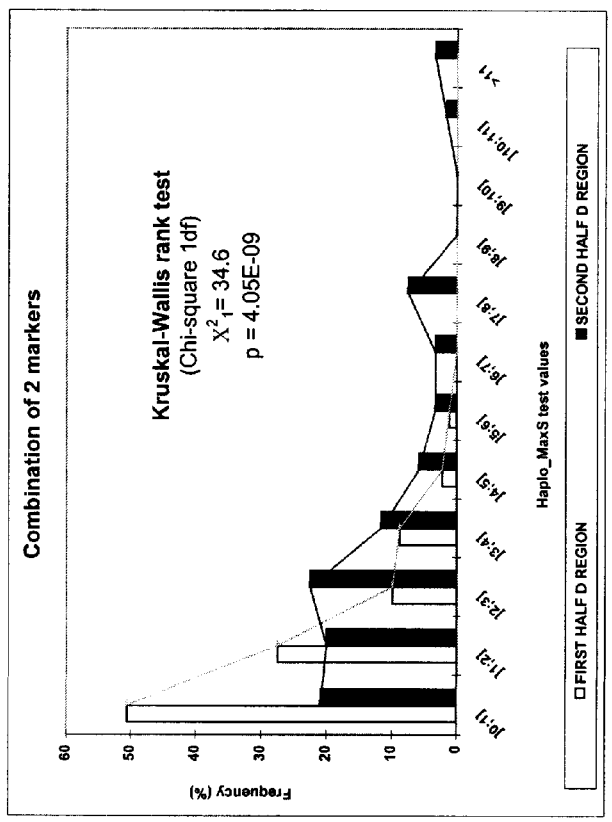
FIG. 11B
FIG. 11A

SCHIZOPHRENIA ASSOCIATED GENE, PROTEINS AND BIALLELIC MARKERS

RELATED APPLICATIONS

This application is a continuation-in-part of U.S. patent application Ser. No. 09/539,333, filed Mar. 30, 2000, now U.S. Pat. No. 6,476,208 and U.S. patent application No. 09/416,384, filed Oct. 12, 1999. This application also claims priority to U.S. Provisional Patent Application No. 60/168,088, filed Nov. 30, 1999. All of the above applications are hereby incorporated by reference in their entireties.

FIELD OF THE INVENTION

The invention concerns the human g35030 gene, and g35030 polynucleotides, polypeptides, as well as biallelic markers localized in the g35030 gene and in the human chromosome 13q31–q33 region. The invention also concerns the association established between schizophrenia and bipolar disorder and the biallelic markers and the g35030 gene and nucleotide sequences. The invention provides means to identify compounds useful in the treatment of schizophrenia, bipolar disorder and related diseases, means to determine the predisposition of individuals to said disease as well as means for the disease diagnosis and prognosis.

BACKGROUND OF THE INVENTION

Advances in the technological armamentarium available to basic and clinical investigators have enabled increasingly sophisticated studies of brain and nervous system function in health and disease. Numerous hypotheses both neurobiological and pharmacological have been advanced with respect to the neurochemical and genetic mechanisms involved in central nervous system (CNS) disorders, including psychiatric disorders and neurodegenerative diseases. However, CNS disorders have complex and poorly understood etiologies, as well as symptoms that are overlapping, poorly characterized, and difficult to measure. As a result future treatment regimes and drug development efforts will be required to be more sophisticated and focused on multigenic causes, and will need new assays to segment disease populations, and provide more accurate diagnostic and prognostic information on patients suffering from CNS disorders.

Genetic Analysis of Complex Traits

Until recently, the identification of genes linked with detectable traits has relied mainly on a statistical approach called linkage analysis. Linkage analysis is based upon establishing a correlation between the transmission of genetic markers and that of a specific trait throughout generations within a family. Linkage analysis involves the study of families with multiple affected individuals and is useful in the detection of inherited-traits, which are caused by a single gene, or possibly a very small number of genes. But, linkage studies have proven difficult when applied to complex genetic traits. Most traits of medical relevance do not follow simple Mendelian monogenic inheritance. However, complex diseases often aggregate in families, which suggests that there is a genetic component to be found. Such complex traits are often due to the combined action of multiple genes as well as environmental factors. Such complex trait, include susceptibilities to heart disease, hypertension, diabetes, cancer and inflammatory diseases. Drug efficacy, response and tolerance/toxicity can also be considered as multifactoral traits involving a genetic component in the same way as complex diseases. Linkage analysis cannot be applied to the study of such traits for which no large informative families are available. Moreover, because of their low penetrance, such complex traits do not segregate in a clear-cut Mendelian manner as they are passed from one generation to the next. Attempts to map such diseases have been plagued by inconclusive results, demonstrating the need for more sophisticated genetic tools.

Knowledge of genetic variation in the neuronal and endocrine systems is important for understanding why some people are more susceptible to disease or respond differently to treatments. Ways to identify genetic polymorphism and to analyze how they impact and predict disease susceptibility and response to treatment are needed.

Although the genes involved in the neuronal and endocrine systems represent major drug targets and are of high relevance to pharmaceutical research, we still have scant knowledge concerning the extent and nature of, sequence variation in these genes and their regulatory elements. In the case where polymorphisms have been identified the relevance of the variation is rarely understood. While polymorphisms hold promise for use as genetic markers in determining which genes contribute to multigenic or quantitative traits, suitable markers and suitable methods for exploiting those markers have not been found and brought to bare on the genes related to disorders of the brain and nervous system.

The basis for accomplishment of these goals is to use genetic association analysis to detect markers that predict susceptibility for these traits. Recently, advances in the fields of genetics and molecular biology have allowed identification of forms, or alleles, of human genes that lead to diseases. Most of the genetic variations responsible for human diseases identified so far, belong to the class of single gene disorders. As this name implies, the development of single gene disorders is determined, or largely influenced, by the alleles of a single gene. The alleles that cause these disorders are, in general, highly deleterious (and highly penetrant) to individuals who carry them. Therefore, these alleles and their associated diseases, with some exceptions, tend to be very rare in the human population. In contrast, most common diseases and non-disease traits, such as a physiological response to a pharmaceutical agent, can be viewed as the result of many complex factors. These can include environmental exposures (toxins, allergens, infectious agents, climate, and trauma) as well as multiple genetic factors.

Association studies seek to analyze the distributions of chromosomes that have occurred in populations of unrelated (at least not directly related) individuals. An assumption in this type of study is that genetic alleles that result in susceptibility for a common trait arose by ancient mutational events on chromosomes that have been passed down through many generations in the population. These alleles can become common throughout the population in part because the trait they influence, if deleterious, is only expressed in a fraction of those individuals who carry them. Identification of these "ancestral" chromosomes is made difficult by the fact that genetic markers are likely to have become separated from the trait susceptibility allele through the process of recombination, except in regions of DNA which immediately surround the allele. The identities of genetic markers contained within the fragments of DNA surrounding a susceptibility allele will be the same as those from the ancestral chromosome on which the allele arose. Therefore, individuals from the population who express a complex trait might be expected to carry the same set of genetic markers in the vicinity of a susceptibility allele more often than those who do not express the trait; that is these markers will show an association with the trait.

Schizophrenia

Schizophrenia is one of the most severe and debilitating of the major psychiatric diseases. It usually starts in late adolescence or early adult life and often becomes chronic and disabling. Men and women are at equal risk of developing this illness; however, most males become ill between 16 and 25 years old, while females develop symptoms between 25 and 30. People with schizophrenia often experience both "positive" symptoms (e.g., delusions, hallucinations, disorganized thinking, and agitation) and "negative" symptoms (e.g., lack of drive or initiative, social withdrawal, apathy, and emotional unresponsiveness).

Schizophrenia affects 1% of the world population. There are an estimated 45 million people with schizophrenia in the world, with more than 33 million of them in the developing countries. This disease places a heavy burden on the patient's family and relatives, both in terms of the direct and indirect costs involved and the social stigma associated with the illness, sometimes over generations. Such stigma often leads to isolation and neglect.

Moreover, schizophrenia accounts for one fourth of all mental health costs and takes up one in three psychiatric hospital beds. Most schizophrenia patients are never able to work. The cost of schizophrenia to society is enormous. In the United States, for example, the direct cost of treatment of schizophrenia has been estimated to be close to 0.5% of the gross national product. Standardized mortality ratios (SMRs) for schizophrenic patients are estimated to be two to four times higher than the general population, and their life expectancy overall is 20% shorter than for the general population. The most common cause of death among schizophrenic patients is suicide (in 10% of patients) which represents a 20 times higher risk than for the general population. Deaths from heart disease and from diseases of the respiratory and digestive system are also increased among schizophrenic patients.

Bipolar Disorder

Bipolar disorders are relatively common disorders with severe and potentially disabling effects. In addition to the severe effects on patients' social development, suicide completion rates among bipolar patients are reported to be about 15%.

Bipolar disorders are characterized by phases of excitement and often including depression; the excitement phases, referred to as mania or hypomania, and depression can alternate or occur in various admixtures, and can occur to different degrees of severity and over varying time periods. Because bipolar disorders can exist in different forms and display different symptoms, the classification of bipolar disorder has been the subject of extensive studies resulting in the definition of bipolar disorder subtypes and widening of the overall concept to include patients previously thought to be suffering from different disorders. Bipolar disorders often share certain clinical signs, symptoms, treatments and neurobiological features with psychotic illnesses in general and therefore present a challenge to the psychiatrist to make an accurate diagnosis. Furthermore, because the course of bipolar disorders and various mood and psychotic disorders can differ greatly, it is critical to characterize the illness as early as possible in order to offer means to manage the illness over a long term.

Bipolar disorders appear in about 1.3% of the population and have been reported to constitute about half of the mood disorders seen in a psychiatric clinic. Bipolar disorders have been found to vary with gender depending of the type of disorder; for example, bipolar disorder I is found equally among men and women, while bipolar disorder II is reportedly more common in women. The age of onset of bipolar disorders is typically in the teenage years and diagnosis is typically made in the patient's early twenties. Bipolar disorders also occur among the elderly, generally as a result of a medical or neurological disorder.

The costs of bipolar disorders to society are enormous. The mania associated with the disease impairs performance and causes psychosis, and often results in hospitalization. This disease places a heavy burden on the patient's family and relatives, both in terms of the direct and indirect costs involved and the social stigma associated with the illness, sometimes over generations. Such stigma often leads to isolation and neglect. Furthermore, the earlier the onset, the more severe are the effects of interrupted education and social development.

The DSM-IV classification of bipolar disorder distinguishes among four types of disorders based on the degree and duration of mania or hypomania as well as two types of disorders which are evident typically with medical conditions or their treatments, or to substance abuse. Mania is recognized by elevated, expansive or irritable mood as well as by distractability, impulsive behavior, increased activity, grandiosity, elation, racing thoughts, and pressured speech. Of the four types of bipolar disorder characterized by the particular degree and duration of mania, DSM-IV includes:

- bipolar disorder I, including patients displaying mania for at least one week;
- bipolar disorder II, including patients displaying hypomania for at least 4 days, characterized by milder symptoms of excitement than mania, who have not previously displayed mania, and have previously suffered from episodes of major depression;
- bipolar disorder not otherwise specified (NOS), including patients otherwise displaying features of bipolar disorder II but not meeting the 4 day duration for the excitement phase, or who display hypomania without an episode of major depression; and
- cyclothymia, including patients who show numerous manic and depressive symptoms that do not meet the criteria for hypomania or major depression, but which are displayed for over two years without a symptom-free interval of more than two months.

The remaining two types of bipolar disorder as classified in DSM-VI are disorders evident or caused by various medical disorder and their treatments, and disorders involving or related to substance abuse. Medical disorders which can cause bipolar disorders typically include endocrine disorders and cerebrovascular injuries, and medical treatments causing bipolar disorder are known to include glucocorticoids and the abuse of stimulants. The disorder associated with the use or abuse of a substance is referred to as "substance induced mood disorder with manic or mixed features".

Diagnosis of bipolar disorder can be very challenging. One particularly troublesome difficulty is that some patients exihibit mixed states, simultaneously manic and dysphoric or depressive, but do not fall into the DSM-IV classification because not all required criteria for mania and major depression are met daily for at least one week. Other difficulties include classification of patients in the DSM-IV groups based on duration of phase since patients often cycle between excited and depressive episodes at different rates. In particular, it is reported that the use of antidepressants may alter the course of the disease for the worse by causing "rapid-cycling". Also making diagnosis more difficult is the fact that bipolar patients, particularly at what is known as Stage III mania, share symptoms of disorganized thinking and behavior with bipolar disorder patients. Furthermore, psychiatrists must distinguish between agitated depression and mixed mania; it is common that patients with major depression (14 days or more) exhibit agitiation, resulting in bipolar-like features. A yet further complicating factor is that bipolar patients have an exceptionally high rate of substance, particularly alcohol abuse. While the prevalence of mania in alcoholic patients is low, it is well known that substance abusers can show excited symptoms. Difficulties therefore result for the diagnosis of bipolar patients with substance abuse.

Treatment

As there are currently no cures for bipolar disorder or schizophrenia, the objective of treatment is to reduce the severity of the symptoms, if possible to the point of remission. Due to the similarities in symptoms, schizophrenia and bipolar disorder are often treated with some of the same medicaments. Both diseases are often treated with antipsychotics and neuroleptics.

For schizophrenia, for example, antipsychotic medications are the most common and most valuable treatments. There are four main classes of antipsychotic drugs which are commonly prescribed for schizophrenia. The first, neuroleptics, exemplified by chlorpromazine (Thorazine), has revolutionized the treatment of schizophrenic patients by reducing positive (psychotic) symptoms and preventing their recurrence. Patients receiving chlorpromazine have been able to leave mental hospitals and live in community programs or their own homes. But these drugs are far from ideal. Some 20% to 30% of patients do not respond to them at all, and others eventually relapse. These drugs were named neuroleptics because they produce serious neurological side effects, including rigidity and tremors in the arms and legs, muscle spasms, abnormal body movements, and akathisia (restless pacing and fidgeting). These side effects are so troublesome that many patients simply refuse to take the drugs. Besides, neuroleptics do not improve the so-called negative symptoms of schizophrenia and the side effects may even exacerbate these symptoms. Thus, despite the clear beneficial effects of neuroleptics, even some patients who have a good short-term response will ultimately deteriorate in overall functioning.

The well known deficiencies in the standard neuroleptics have stimulated a search for new treatments and have led to a new class of drugs termed atypical neuroleptics. The first atypical neuroleptic, Clozapine, is effective for about one third of patients who do not respond to standard neuroleptics. It seems to reduce negative as well as positive symptoms, or at least exacerbates negative symptoms less than standard neuroleptics do. Moreover, it has beneficial effects on overall functioning and may reduce the chance of suicide in schizophrenic patients. It does not produce the troubling neurological symptoms of the standard neuroleptics, or raise blood levels of the hormone prolactin, excess of which may cause menstrual irregularities and infertility in women, impotence or breast enlargement in men. Many patients who cannot tolerate standard neuroleptics have been able to take clozapine. However, clozapine has serious limitations. It was originally withdrawn from the market because it can cause agranulocytosis, a potentially lethal inability to produce white blood cells. Agranulocytosis remains a threat that requires careful monitoring and periodic blood tests. Clozapine can also cause seizures and other disturbing side effects (e.g., drowsiness, lowered blood pressure, drooling, bed-wetting, and weight gain). Thus it is usually taken only by patients who do not respond to other drugs.

Researchers have developed a third class of antipsychotic drugs that have the virtues of clozapine without its defects. One of these drugs is risperidone (Risperdal). Early studies suggest that it is as effective as standard neuroleptic drugs for positive symptoms and may be somewhat more effective for negative symptoms. It produces more neurological side effects than clozapine but fewer than standard neuroleptics. However, it raises prolactin levels. Risperidone is now prescribed for a broad range of psychotic patients, and many clinicians seem to use it before clozapine for patients who do not respond to standard drugs, because they regard it as safer. Another new drug is Olanzapine (Zyprexa) which is at least as effective as standard drugs for positive symptoms and more effective for negative symptoms. It has few neurological side effects at ordinary clinical doses, and it does not significantly raise prolactin levels. Although it does not produce most of clozapine's most troubling side effects, including agranulocytosis, some patients taking olanzapine may become sedated or dizzy, develop dry mouth, or gain weight. In rare cases, liver function tests become transiently abnormal.

Outcome studies in schizophrenia are usually based on hospital treatment studies and may not be representative of the population of schizophrenia patients. At the extremes of outcome, 20% of patients seem to recover completely after one episode of psychosis, whereas 14–19% of patients develop a chronic unremitting psychosis and never fully recover. In general, clinical outcome at five years seems to follow the rule of thirds: with about 35% of patients in the poor outcome category; 36% in the good outcome category, and the remainder with intermediate outcome. Prognosis in schizophrenia does not seem to worsen after five years.

Whatever the reasons, there is increasing evidence that leaving schizophrenia untreated for long periods early in course of the illness may negatively affect the outcome. However, the use of drugs is often delayed for patients experiencing a first episode of the illness. The patients may not realize that they are ill, or they may be afraid to seek help; family members sometimes hope the problem will simply disappear or cannot persuade the patient to seek treatment; clinicians may hesitate to prescribe antipsychotic medications when the diagnosis is uncertain because of potential side effects. Indeed, at the first manifestation of the disease, schizophrenia is difficult to distinguish from bipolar manic-depressive disorders, severe depression, drug-related disorders, and stress-related disorders. Since the optimum treatments differ among these diseases, the long term prognosis of the disorder also differs the beginning of the treatment.

For both schizophrenia and bipolar disorder, all the known molecules used for the treatment of schizophrenia have side effects and act only against the symptoms of the disease. There is a strong need for new molecules without associated side effects and directed against targets which are involved in the causal mechanisms of schizophrenia and bipolar disorder. Therefore, tools facilitating the discovery and characterization of these targets are necessary and useful.

The aggregation of schizophrenia and bipolar disorder in families, the evidence from twin and adoption studies, and the lack of variation in incidence worldwide, indicate that schizophrenia and bipolar disorder are primarily genetic conditions, although environmental risk factors are also involved at some level as necessary, sufficient, or interactive causes. For example, schizophrenia occurs in 1% of the general population. But, if there is one grandparent with schizophrenia, the risk of getting the illness increases to about 3%; one parent with Schizophrenia, to about 10%. When both parents have schizophrenia, the risk rises to approximately 40%.

Consequently, there is a strong need to identify genes involved in schizophrenia and bipolar disorder. The knowledge of these genes will allow researchers to understand the etiology of schizophrenia and bipolar disorder and could lead to drugs and medications which are directed against the cause of the diseases, not just against their symptoms.

There is also a great need for new methods for detecting a susceptibility to schizophrenia and bipolar disorder, as well as for preventing or following up the development of the disease. Diagnostic tools could also prove extremely useful. Indeed, early identification of subjects at risk of developing schizophrenia would enable early and/or prophylactic treatment to be administered. Moreover, accurate assessments of the eventual efficacy of a medicament as well as the patent's eventual tolerance to it may enable clinicians to enhance the benefit/risk ratio of schizophrenia and bipolar disorder treatment regimes.

SUMMARY OF THE INVENTION

The present invention stems from the identification of novel polymorphisms including biallelic markers located on the human chromosome 13q31–q33 locus, the identification and characterization of novel schizophrenia-related genes located on the human chromosome 13q31–q33 locus, and from the identification of genetic associations between alleles of biallelic markers located on the human chromosome 13q31–q33 locus and disease, as confirmed and characterized in a panel of human subjects. The invention furthermore provides a fine structure map of the region which includes the schizophrenia-associated gene sequences.

The present invention pertains to nucleic acid molecules comprising the genomic sequences of novel human genes encoding g35030 proteins, proteins encoded thereby, as well as antibodies thereto. The g35030 genomic sequences may also comprise regulatory sequence located upstream (5'-end) and downstream (3'-end) of the transcribed portion of said gene, these regulatory sequences being also part of the invention. The invention also deals with the cDNA sequences encoding g35030 proteins.

Oligonucleotide probes or primers hybridizing specifically with a g35030 genomic or cDNA sequence are also part of the present invention, as well as DNA amplification and detection methods using said primers and probes.

A further object of the invention consists of recombinant vectors comprising any of the nucleic acid sequences described above, and in particular of recombinant vectors comprising a g35030 regulatory sequence or a sequence encoding a g35030 protein, as well as of cell hosts and transgenic non human animals comprising said nucleic acid sequences or recombinant vectors.

The invention also concerns to biallelic markers of the g35030 gene and the use thereof. Included are probes and primers for use in genotyping biallelic markers of the invention.

An embodiment of the invention encompasses any polynucleotide of the invention attached to a solid support polynucleotide may comprise a sequence disclosed in the present specification; optionally, said polynucleotide may comprise, consist of, or consist essentially of any polynucleotide described in the present specification; optionally, said determining may be performed in a hybridization assay, sequencing assay, microsequencing assay, or an enzyme-based mismatch detection assay; optionally, said polynucleotide may be attached to a solid support, array, or addressable array; optionally, said polynucleotide may be labeled.

Finally, the invention is directed to drug screening assays and methods for the screening of substances for the treatment of schizophrenia, bipolar disorder or a related CNS disorder. One object of the invention deals with animal models of schizophrenia, including mouse, primate, non-human primate bipolar disorder or related CNS disorder. The invention is also directed to methods for the screening of substances or molecules that modulate the expression of g35030, as well as with methods for the screening of substances or molecules that interact with a g35030 polypeptide, or that modulate the activity of a g35030 polypeptide.

As noted above, certain aspects of the present invention stem from the identification of genetic associations between schizophrenia and bipolar disorder and alleles of biallelic markers located on the human chromosome 13q31–q33 region, and more particularly on a subregion thereof referred to herein as Region D. The invention provides appropriate tools for establishing further genetic associations between alleles of biallelic markers on the 13q31–13q33 locus and either side effects or benefit resulting from the administration of agents acting on schizophrenia or bipolar disorder, or schizophrenia or bipolar disorder symptoms, including agents like chlorpromazine, clozapine, risperidone, olanzapine, sertindole, quetiapine and ziprasidone.

The invention provides appropriate tools for establishing further genetic associations between alleles of biallelic markers on the 13q31–q33 locus and a trait. Methods and products are provided for the molecular detection of a genetic susceptibility in humans to schizophrenia and bipolar disorder. They can be used for diagnosis, staging, prognosis and monitoring of this disease, which processes can be further included within treatment approaches. The invention also provides for the efficient design and evaluation of suitable therapeutic solutions including individualized strategies for optimizing drug usage, and screening of potential new medicament candidates.

Additional embodiments are set forth in the Detailed Description of the Invention and in the Examples.

BRIEF DESCRIPTION OF THE FIGURES

FIG. 3 is a table demonstrating the results of a haplotype association analysis between total French Canadian schizophrenia cases and haplotypes which consist of chromosome 13q31–q33 biallelic markers of the invention.

FIG. 4 is a table showing the involvement of selected biallelic markers of the invention in statistically significant haplotypes.

FIG. 5 is a table demonstrating the results of a haplotype association analysis between French Canadian schizophrenia cases and haplotypes which consist of chromosome 13q31–q33 biallelic markers of the invention.

FIG. 6 is a table demonstrating the results of a haplotype association analysis between French Canadian schizophrenia cases and haplotypes which consist of chromosome 13q31–q33 biallelic markers of the invention.

between schizophrenia cases and haplotypes comprising Region D biallelic markers of the invention.

Figures 8A, 8B:
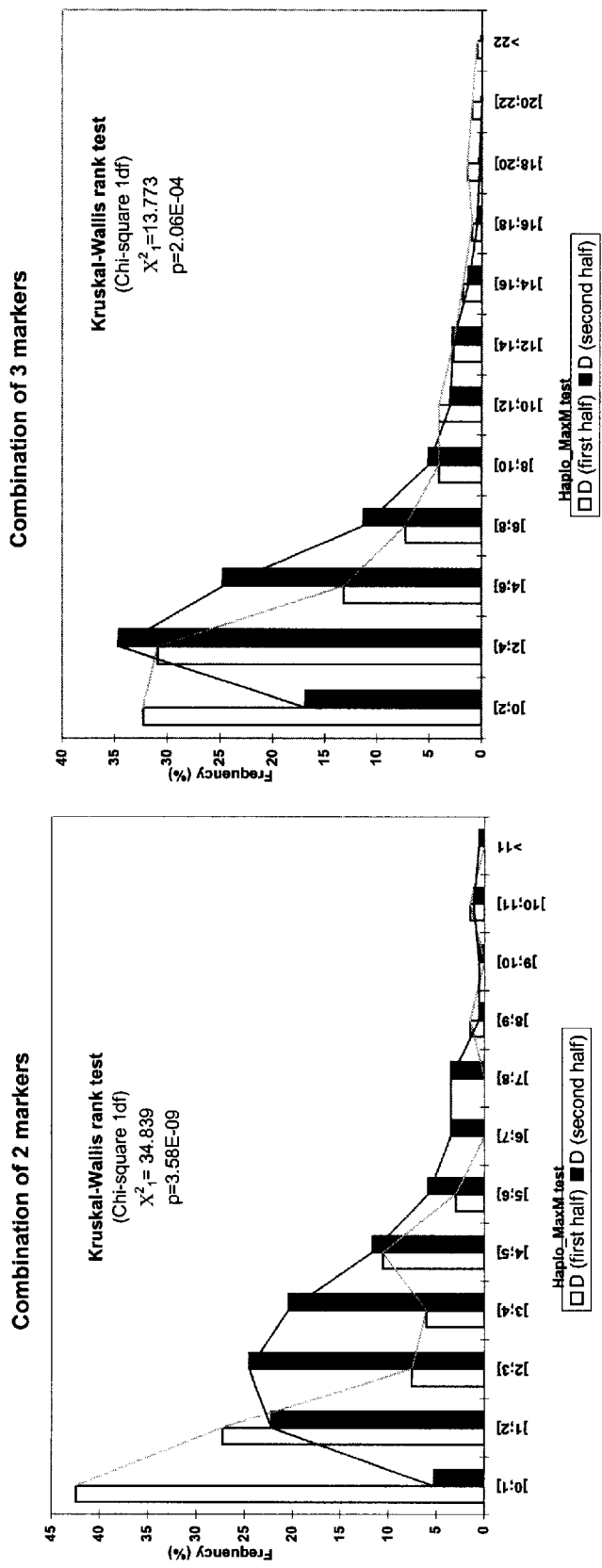

FIGS. 8A and 8B show the results of a haplotype association analysis (HaplotMaxM test value distribution) between schizophrenia cases and haplotypes comprising Region D biallelic markers of the invention.

Figures 9A, 9B:
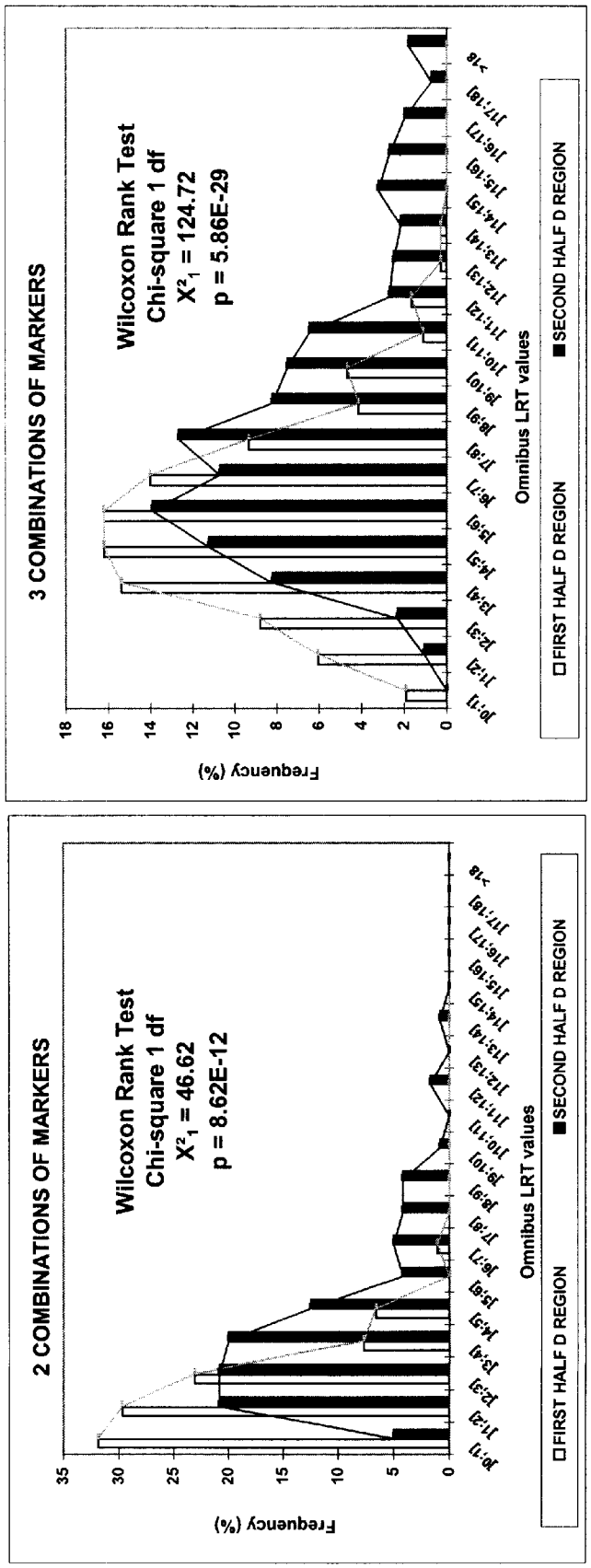

FIGS. 9A and 9B show the results of a haplotype association analysis (Omnibus LR test value distribution) between bipolar disorder cases and haplotypes comprising Region D biallelic markers of the invention.

Figure 10A:
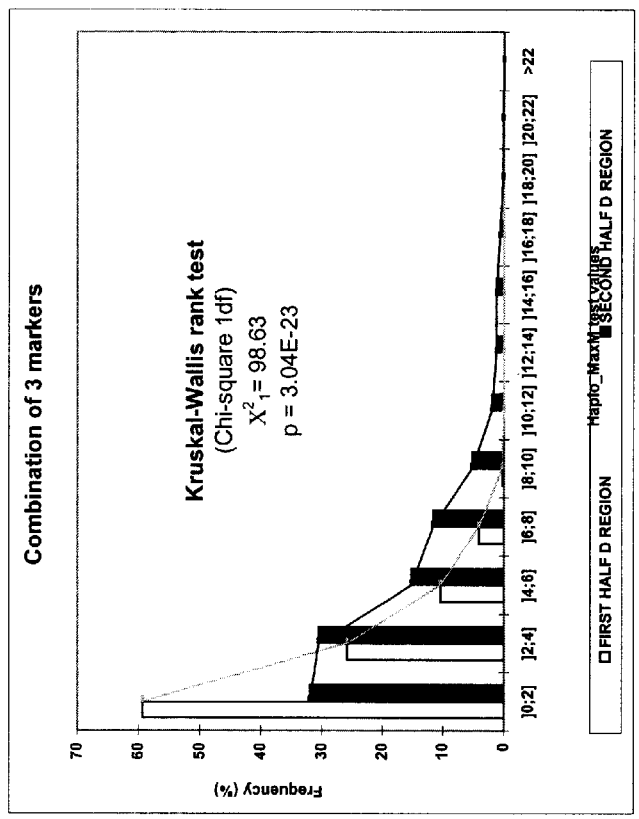
Figure 10B:
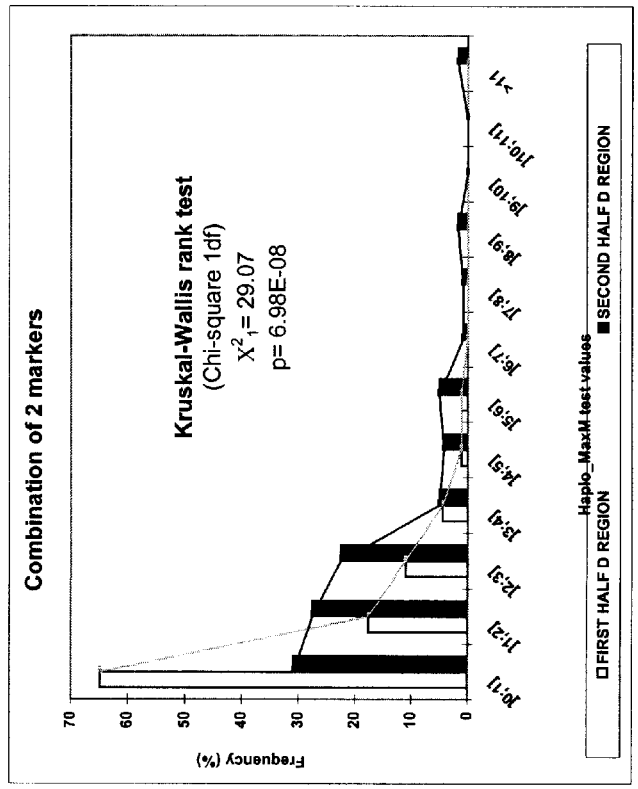

FIGS. 10A and 10B show the results of a haplotype association analysis (HaploMaxM test value distribution) between bipolar disorder cases and haplotypes comprising Region D biallelic markers of the invention.

FIGS. 11A and 11B show the results of a haplotype association analysis (HaploMaxS test value distribution) between bipolar disorder cases and haplotypes comprising Region D biallelic markers of the invention.

Figure 12:
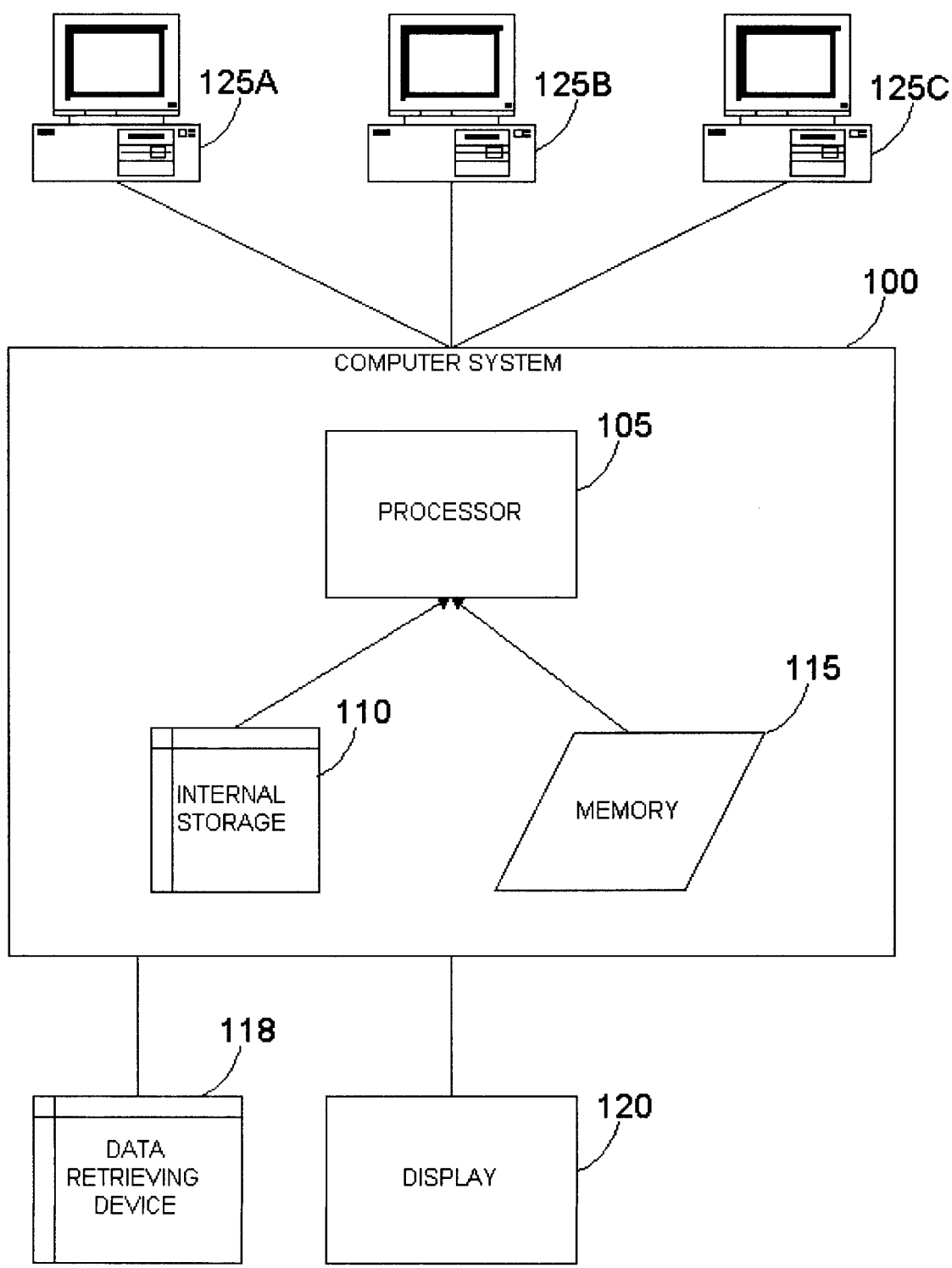

FIG. 12 is a block diagram of an exemplary computer system.

Figure 13:
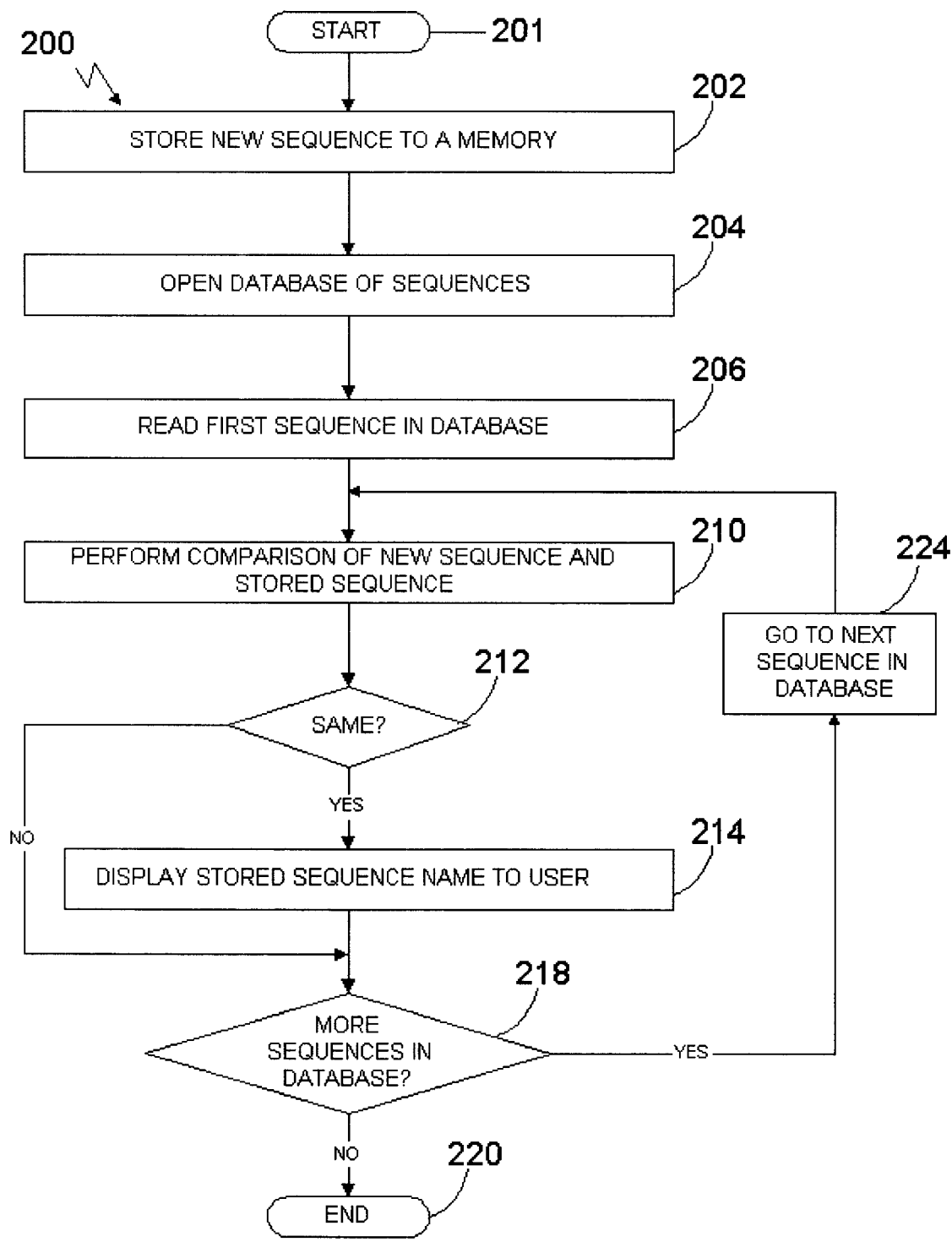

FIG. 13 is a flow diagram illustrating one embodiment of a process 200 for comparing a new nucleotide or protein sequence with a database of sequences in order to determine the homology levels between the new sequence and the sequences in the database.

Figure 14:
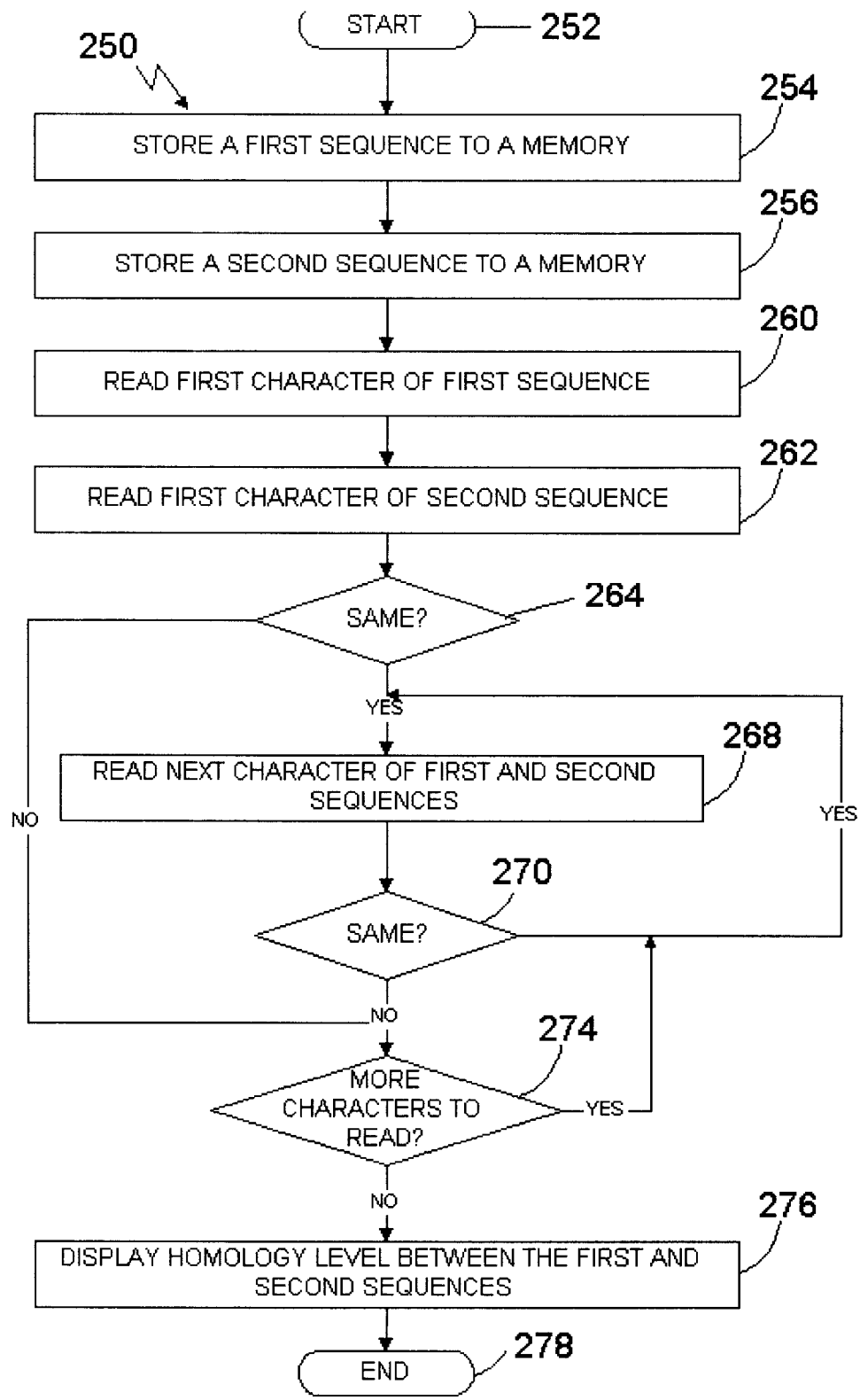

FIG. 14 is a flow diagram illustrating one embodiment of a process 250 in a computer for determining whether two sequences are homologous.

Figure 15:
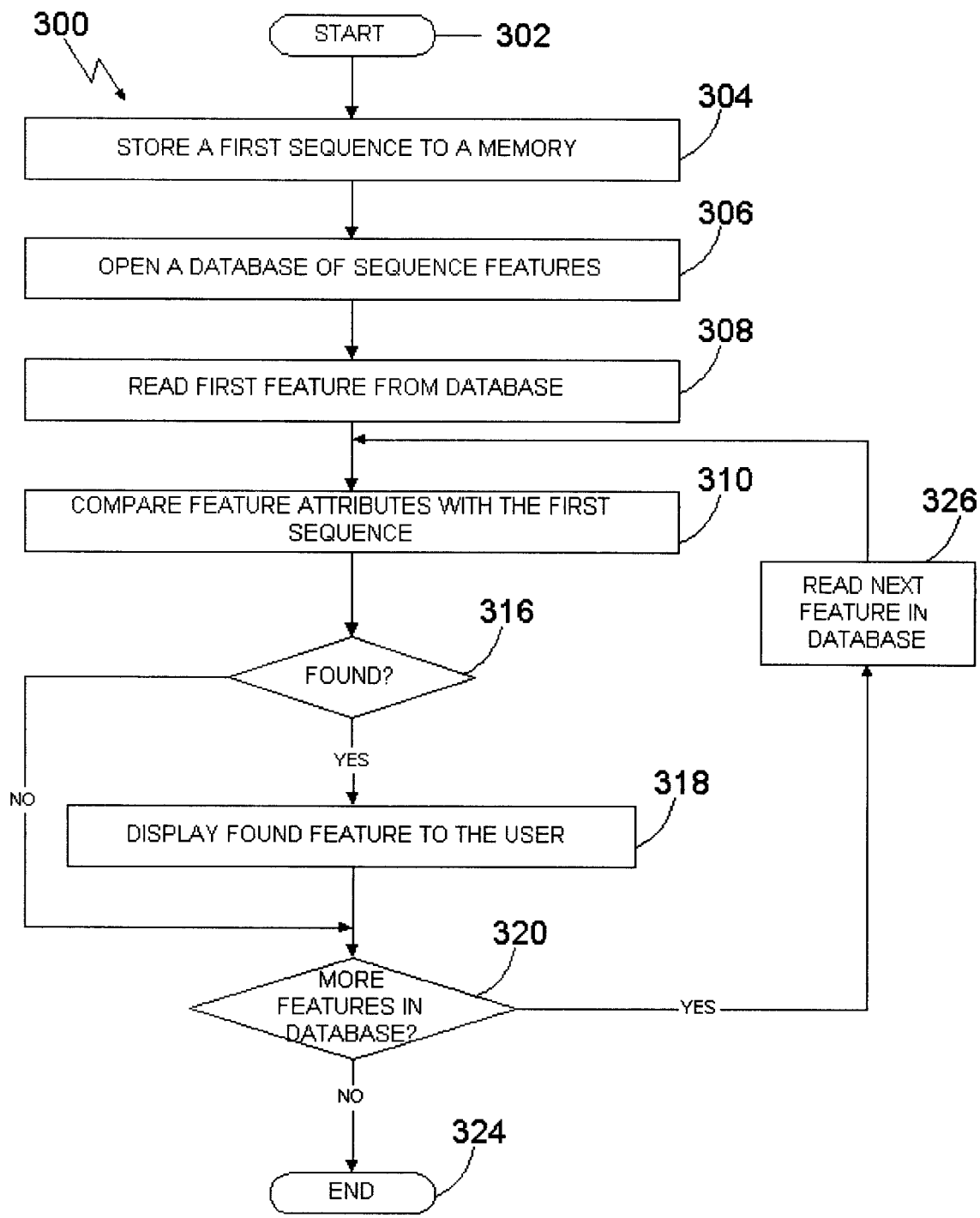

FIG. 15 is a flow diagram illustrating one embodiment of an identifier process 300 for detecting the presence of a feature in a sequence.

BRIEF DESCRIPTION OF THE SEQUENCES PROVIDED IN THE SEQUENCE LISTING

SEQ ID No. 1 contains the approximately 319 kb of genomic nucleotide sequence comprising g35030 nucleic acid sequences and the biallelic markers A1 to A71 located on the human chromosome 13q31–q33 locus.

SEQ ID Nos. 2 to 17 contain cDNA sequences of the g35030 gene.

SEQ ID Nos. 18 to 23 contain amino acid sequences of g35030 polypeptides, encoded by cDNAs of the invention.

SEQ ID Nos. 24 to 78 respectively contain the nucleotide sequence of the amplicons which comprise the biallelic markers A72 to A127 located on the human chromosome 13q31–q33 locus.

SEQ ID No. 79 to 132 contain genomic nucleotide sequences comprising exons of the g35030 gene from several different primates.

SEQ ID No 133 contains a primer containing the additional PU 5' sequence described further in Example 2.

SEQ ID No 134 contains a primer containing the additional RP 5' sequence described further in Example 2.

In accordance with the regulations relating to Sequence Listings, the following codes have been used in the Sequence Listing to indicate the locations of biallelic markers within the sequences and to identify each of the alleles present at the polymorphic base. The code "r" in the sequences indicates that one allele of the polymorphic base is a guanine, while the other allele is an adenine. The code "y" in the sequences indicates that one allele of the polymorphic base is a thymine, while the other allele is a cytosine. The code "m" in the sequences indicates that one allele of the polymorphic base is an adenine, while the other allele is an cytosine. The code "k" in the sequences indicates that one allele of the polymorphic base is a guanine, while the other allele is a thymine. The code "s" in the sequences indicates that one allele of the polymorphic base is a guanine, while the other allele is a cytosine. The code "w" in the sequences indicates that one allele of the polymorphic base is an adenine, while the other allele is an thymine.

DETAILED DESCRIPTION OF THE INVENTION

The identification of genes involved in a particular trait such as a specific central nervous system disorder, like schizophrenia, can be carried out through two main strategies currently used for genetic mapping: linkage analysis and association studies. Linkage analysis requires the study of families with multiple affected individuals and is now useful in the detection of mono- or oligogenic inherited traits. Conversely, association studies examine the frequency of marker alleles in unrelated trait (T+) individuals compared with trait negative (T−) controls, and are generally employed in the detection of polygenic inheritance.

Candidate Region on the Chromosome 13 (Linkage Analysis)

Genetic link or "linkage" is based on an analysis of which of two neighboring sequences on a chromosome contains the least recombinations by crossing-over during meiosis. To do this, chromosomal markers, like microsatellite markers, have been localized with precision on the genome. Genetic link analysis calculates the probabilities of recombinations on the target gene with the chromosomal markers used, according to the genealogical tree, the transmission of the disease, and the transmission of the markers. Thus, if a particular allele of a given marker is transmitted with the disease more often than chance would have it (recombination level between 0 and 0.5), it is possible to deduce that the target gene in question is found in the neighborhood of the marker.

Using this technique, it has been possible to localize several genes demonstrating a genetic predisposition of familial cancers. In order to be able to be included in a genetic link study, the families affected by a hereditary form of the disease must satisfy the "informativeness" criteria: several affected subjects (and whose constitutional DNA is available) per generation, and at best having a large number of siblings.

By linkage analysis, observations have been made, according to which a candidate region for schizophrenia is present on chromosome 13q32 locus (Blouin et al., 1998). Linkage analysis has been successfully applied to map simple genetic traits that show clear Mendelian inheritance patterns and which have a high penetrance, but this method suffers from a variety of drawbacks. First, linkage analysis is limited by its reliance on the choice of a genetic model suitable for each studied trait. Furthermore, the resolution attainable using linkage analysis is limited, and complementary studies are required to refine the analysis of the typical 20 Mb regions initially identified through this method. In addition, linkage analysis have proven difficult when applied to complex genetic traits, such as those due to the combined action of multiple genes and/or environmental factors. In such cases, too great an effort and cost are needed to recruit the adequate number of affected families required for applying linkage analysis to these situations. Finally, linkage analysis cannot be applied to the study of traits for which no large informative families are available.

In the present invention alternative means for conducting association studies rather than linkage analysis between markers located on the chromosome 13q31–q33 locus and a trait, preferably schizophrenia or bipolar disorder, are disclosed.

In the present application, additional biallelic markers located on the human chromosome 13q31–q33 locus associated with schizophrenia are disclosed. The identification of these biallelic markers in association with schizophrenia has allowed for the further definition of the chromosomal region suspected of containing a genetic determinant involved in a predisposition to develop schizophrenia and has resulted in the identification of novel gene sequences disclosed herein which are associated with a predisposition to develop schizophrenia. The present invention thus provides an extensive fine structure map of the 13q31–q33 locus, including novel biallelic markers located on the human 13q31–q33 locus, approximately 319 kb of genomic nucleotide sequence of a subregion of the human 13q31–q33 locus, and polymorphisms including biallelic markers and nucleotide deletions in said 319 kb genomic sequence. The biallelic markers of the human chromosome 13q31–q33 locus and the nucleotide sequences, polymorphisms and gene sequences located in Region D subregion of the human chromosome 13q31–q33 locus are useful as genetic and physical markers for further mapping studies. These identified polymorphisms are used in the design of assays for the reliable detection of genetic susceptibility to schizophrenia and bipolar disorder. They can also be used in the design of drug screening protocols to provide an accurate and efficient evaluation of the therapeutic and side-effect potential of new or already existing medicament or treatment regime.

Using the biallelic markers, the inventors have identified the g35030 candidate schizophrenia gene, further described herein. The sequences comprising the the schizophrenia-associated genes are useful, for example, for the isolation of other genes in putative gene families, the identification of homologs from other species, for the development of medicaments for treatment of disease, and as probes and primers for diagnostic or screening assays as described herein.

Definitions

As used interchangeably herein, the term "oligonucleotides", and "polynucleotides" include RNA, DNA, or RNA/DNA hybrid sequences of more than one nucleotide in either single chain or duplex form. The term "nucleotide" as used herein as an adjective to describe molecules comprising RNA, DNA, or RNA/DNA hybrid sequences of any length in single-stranded or duplex form. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. Although the term "nucleotide" is also used herein to encompass "modified nucleotides" which comprise at least one modifications (a) an alternative linking group, (b) an analogous form of purine, (c) an analogous form of pyrimidine, or (d) an analogous sugar, for examples of analogous linking groups, purine, pyrimidines, and sugars see for example PCT publication No. WO 95/04064. However, the polynucleotides of the invention are preferably comprised of greater than 50% conventional deoxyribose nucleotides, and most preferably greater than 90% conventional deoxyribose nucleotides. The polynucleotide sequences of the invention may be prepared by any known method, including synthetic, recombinant, ex vivo generation, or a combination thereof, as well as utilizing any purification methods known in the art.

As used herein, the term "purified" does not require absolute purity; rather, it is intended as a relative definition. Purification of starting material or natural material is at least one order of magnitude, preferably two or three orders, and more preferably four or five orders of magnitude is expressly contemplated. As an example, purification from 0.1% concentration to 10% concentration is two orders of magnitude.

To illustrate, individual cDNA clones isolated from a cDNA library have been conventionally purified to electrophoretic homogeneity. The sequences obtained from these clones could not be obtained directly either from the library or from total human DNA. The cDNA clones are not naturally occurring as such, but rather are obtained via manipulation of a partially purified naturally occurring substance (messenger RNA). The conversion of mRNA into a cDNA library involves the creation of a synthetic substance (cDNA) and pure individual cDNA clones can be isolated from the synthetic library by clonal selection. Thus, creating a cDNA library from messenger RNA and subsequently isolating individual clones from that library results in an approximately $10^4$–$10^6$ fold purification of the native message.

The term "purified" is further used herein to describe a polypeptide or polynucleotide of the invention which has been separated from other compounds including, but not limited to, polypeptides or polynucleotides, carbohydrates, lipids, etc. The term "purified" may be used to specify the separation of monomeric polypeptides of the invention from oligomeric forms such as homo- or hetero-dimers, trimers, etc. The term "purfied" may also be used to specify the separation of covalently closed polynucleotides from linear polynucleotides. A polynucleotide is substantially pure when at least about 50%, preferably 60 to 75% of a sample exhibits a single polynucleotide sequence and conformation (linear versus covalently close). A substantially pure polypeptide or polynucleotide typically comprises about 50%, preferably 60 to 90% weight/weight of a polypeptide or polynucleotide sample, respectively, more usually about 95%, and preferably is over about 99% pure. Polypeptide and polynucleotide purity, or homogeneity, is indicated by a number of means well known in the art, such as agarose or polyacrylamide gel electrophoresis of a sample, followed by visualizing a single band upon staining the gel. For certain purposes higher resolution can be provided by using HPLC or other means well known in the art. As an alternative embodiment, purification of the polypeptides and polynucleotides of the present invention may be expressed as "at least" a percent purity relative to heterologous polypeptides and polynucleotides (DNA, RNA or both). As a preferred embodiment, the polypeptides and polynucleotides of the present invention are at least; 10%, 20%, 30%, 40%, 50%, 60%, 70%, 80%, 90%, 95%, 96%, 96%, 98%, 99%, or 100% pure relative to heterologous polypeptides and polynucleotides, respectively. As a further preferred embodiment the polypeptides and polynucleotides have a purity ranging from any number, to the thousandth position, between 90% and 100% (e.g., a polypeptide or polynucleotide at least 99.995% pure) relative to either heterologous polypeptides or polynucleotides, respectively, or as a weight/weight ratio relative to all compounds and molecules other than those existing in the carrier. Each number representing a percent purity, to the thousandth position, may be claimed as individual species of purity.

The term "isolated" requires that the material be removed from its original environment (e.g., the natural environment if it is naturally occurring). For example, a naturally-occurring polynucleotide or polypeptide present in a living animal is not isolated, but the same polynucleotide or DNA or polypeptide, separated from some or all of the coexisting materials in the natural system, is isolated. Such polynucleotide could be part of a vector and/or such polynucleotide or polypeptide could be part of a composition, and still be isolated in that the vector or composition is not part of its natural environment.

The term "primer" denotes a specific oligonucleotide sequence which is complementary to a target nucleotide sequence and used to hybridize to the target nucleotide sequence. A primer serves as an initiation point for nucleotide polymerization catalyzed by either DNA polymerase, RNA polymerase or reverse transcriptase.

The term "probe" denotes a defined nucleic acid segment (or nucleotide analog segment, e.g., polynucleotide as defined herein) which can be used to identify a specific polynucleotide sequence present in samples, said nucleic acid segment comprising a nucleotide sequence complementary of the specific polynucleotide sequence to be identified.

The terms "trait" and "phenotype" are used interchangeably herein and refer to any clinically distinguishable, detectable or otherwise measurable property of an organism such as symptoms of, or susceptibility to a disease for example. Typically the terms "trait" or "phenotype" are used herein to refer to symptoms of, or susceptibility to schizophrenia or bipolar disorder; or to refer to an individual's response to an agent acting on schizophrenia or bipolar disorder; or to refer to symptoms of, or susceptibility to side effects to an agent acting on schizophrenia or bipolar disorder.

The term "allele" is used herein to refer to variants of a nucleotide sequence. A biallelic polymorphism has two forms. Typically the first identified allele is designated as the original allele whereas other alleles are designated as alternative alleles. Diploid organisms may be homozygous or heterozygous for an allelic form.

The term "heterozygosity rate" is used herein to refer to the incidence of individuals in a population, which are heterozygous at a particular allele. In a biallelic system the heterozygosity rate is on average equal to $2P_a(1-P_a)$, where $P_a$ is the frequency of the least common allele. In order to be useful in genetic studies a genetic marker should have an adequate level of heterozygosity to allow a reasonable probability that a randomly selected person will be heterozygous.

The term "genotype" as used herein refers the identity of the alleles present in an individual or a sample. In the context of the present invention a genotype preferably refers to the description of the biallelic marker alleles present in an individual or a sample. The term "genotyping" a sample or an individual for a biallelic marker involves determining the specific allele or the specific nucleotide(s) carried by an individual at a biallelic marker.

The term "mutation" as used herein refers to a difference in DNA sequence between or among different genomes or individuals which has a frequency below 1%.

The term "haplotype" refers to a combination of alleles present in an individual or a sample on a single chromosome. In the context of the present invention a haplotype preferably refers to a combination of biallelic marker alleles found in a given individual and which may be associated with a phenotype.

The term "polymorphism" as used herein refers to the occurrence of two or more alternative genomic sequences or alleles between or among different genomes or individuals. "Polymorphic" refers to the condition in which two or more variants of a specific genomic sequence can be found in a population. A "polymorphic site" is the locus at which the variation occurs. A polymorphism may comprise a substitution, deletion or insertion of one or more nucleotides. A single nucleotide polymorphism is a single base pair change. Typically a single nucleotide polymorphism is the replacement of one nucleotide by another nucleotide at the polymorphic site. Deletion of a single nucleotide or insertion of a single nucleotide, also give rise to single nucleotide polymorphisms. In the context of the present invention "single nucleotide polymorphism" preferably refers to a single nucleotide substitution. Typically, between different genomes or between different individuals, the polymorphic site may be occupied by two different nucleotides.

The terms "biallelic polymorphism" and "biallelic marker" are used interchangeably herein to refer to a polymorphism having two alleles at a fairly high frequency in the population, preferably a single nucleotide polymorphism. A "biallelic marker allele" refers to the nucleotide variants present at a biallelic marker site. Typically the frequency of the less common allele of the biallelic markers of the present invention has been validated to be greater than 1%, preferably the frequency is greater than 10%, more preferably the frequency is at least 20% (i.e. heterozygosity rate of at least 0.32), even more preferably the frequency is at least 30% (i.e. heterozygosity rate of at least 0.42). A biallelic marker wherein the frequency of the less common allele is 30% or more is termed a "high quality biallelic marker." All of the genotyping, haplotyping, association, and interaction study methods of the invention may optionally be performed solely with high quality biallelic markers.

The location of nucleotides in a polynucleotide with respect to the center of the polynucleotide are described herein in the following manner. When a polynucleotide has an odd number of nucleotides, the nucleotide at an equal distance from the 3' and 5' ends of the polynucleotide is considered to be "at the center" of the polynucleotide, and any nucleotide immediately adjacent to the nucleotide at the center, or the nucleotide at the center itself is considered to be "within 1 nucleotide of the center." With an odd number of nucleotides in a polynucleotide any of the five nucleotides positions in the middle of the polynucleotide would be considered to be within 2 nucleotides of the center, and so on. When a polynucleotide has an even number of nucleotides, there would be a bond and not a nucleotide at the center of the polynucleotide. Thus, either of the two central nucleotides would be considered to be "within 1 nucleotide of the center" and any of the four nucleotides in the middle of the polynucleotide would be considered to be "within 2 nucleotides of the center", and so on. For polymorphisms which involve the substitution, insertion or deletion of 1 or more nucleotides, the polymorphism, allele or biallelic marker is "at the center" of a polynucleotide if the difference between the distance from the substituted, inserted, or deleted polynucleotides of the polymorphism and the 3' end of the polynucleotide, and the distance from the substituted, inserted, or deleted polynucleotides of the polymorphism and the 5' end of the polynucleotide is zero or one nucleotide. If this difference is 0 to 3, then the polymorphism is considered to be "within 1 nucleotide of the center." If the difference is 0 to 5, the polymorphism is considered to be "within 2 nucleotides of the center." If the difference is 0 to 7, the polymorphism is considered to be "within 3 nucleotides of the center," and so on. For polymorphisms which involve the substitution, insertion or deletion of 1 or more nucleotides, the polymorphism, allele or biallelic marker is "at the center" of a polynucleotide if the difference between the distance from the substituted, inserted, or deleted polynucleotides of the polymorphism and the 3' end of the polynucleotide, and the distance from the substituted, inserted, or deleted polynucleotides of the polymorphism and the 5' end of the polynucleotide is zero or one nucleotide. If this difference is 0 to 3, then the polymorphism is considered to be "within 1 nucleotide of the center." If the difference is 0 to 5, the polymorphism is considered to be "within 2 nucleotides of the center." If the difference is 0 to 7, the polymorphism is considered to be "within 3 nucleotides of the center," and so on.

The term "upstream" is used herein to refer to a location which, is toward the 5' end of the polynucleotide from a specific reference point.

The terms "base paired" and "Watson & Crick base paired" are used interchangeably herein to refer to nucleotides which can be hydrogen bonded to one another by virtue of their sequence identities in a manner like that found in double-helical DNA with thymine or uracil residues linked to adenine residues by two hydrogen bonds and cytosine and guanine residues linked by three hydrogen bonds (See Stryer, L., *Biochemistry,* 4th edition, 1995).

The terms "complementary" or "complement thereof" are used herein to refer to the sequences of polynucleotides which is capable of forming Watson & Crick base pairing with another specified polynucleotide throughout the entirety of the complementary region. This term is applied to pairs of polynucleotides based solely upon their sequences and not any particular set of conditions under which the two polynucleotides would actually bind.

The terms "g35030 gene", when used herein, encompasses genomic, mRNA and cDNA sequences encoding a g35030 protein, including the untranslated regulatory regions of the genomic DNA.

As used herein the term "13q31–q33-related biallelic marker" relates to a biallelic marker residing in the human chromosome 13q31–q33 region. The term 13q31–q33-related biallelic marker encompasses all of the biallelic markers disclosed in Table 5 and any biallelic markers in linkage disequilibrium therewith, and any biallelic markers in linkage disequilibrium therewith. The preferred chromosome 13q31–q33-related biallelic marker alleles of the present invention include each one the alleles described in Table 5 individually or in groups consisting of all the possible combinations of the alleles listed.

As used herein the term "g35030-related biallelic marker" relates to a set of biallelic markers in linkage disequilibrium with the g35030 gene or a g35030 nucleotide sequence. The term g35030-related biallelic marker encompasses the biallelic markers A13 to A65 disclosed in Table 5 and any biallelic markers in linkage disequilibrium therewith.

The term "polypeptide" refers to a polymer of amino acids without regard to the length of the polymer; thus, peptides, oligopeptides, and proteins are included within the definition of polypeptide. This term also does not specify or exclude prost-expression modifications of polypeptides, for example, polypeptides which include the covalent attachment of glycosyl groups, acetyl groups, phosphate groups, lipid groups and the like are expressly encompassed by the term polypeptide. Also included within the definition are polypeptides which contain one or more analogs of an amino acid (including, for example, non-naturally occurring amino acids, amino acids which only occur naturally in an unrelated biological system, modified amino acids from mammalian systems etc.), polypeptides with substituted linkages, as well as other modifications known in the art, both naturally occurring and non-naturally occurring.

As used herein, the term "non-human animal" refers to any non-human vertebrate, birds and more usually mammals, preferably primates, farm animals such as swine, goats, sheep, donkeys, and horses, rabbits or rodents, more preferably rats or mice. As used herein, the term "animal" is used to refer to any vertebrate, preferable a mammal. Both the terms "animal" and "mammal" expressly embrace human subjects unless preceded with the term "non-human".

As used herein, the term "antibody" refers to a polypeptide or group of polypeptides which are comprised of at least one binding domain, where an antibody binding domain is formed from the folding of variable domains of an antibody molecule to form three-dimensional binding spaces with an internal surface shape and charge distribution complementary to the features of an antigenic determinant of an antigen., which allows an immunological reaction with the antigen. Antibodies include recombinant proteins comprising the binding domains, as wells as fragments, including Fab, Fab', F(ab)$_2$, and F(ab')$_2$ fragments.

As used herein, an "antigenic determinant" is the portion of an antigen molecule, in this case a g35030 polypeptide, that determines the specificity of the antigen-antibody reaction. An "epitope" refers to an antigenic determinant of a polypeptide. An epitope can comprise as few as 3 amino acids in a spatial conformation which is unique to the epitope. Generally an epitope comprises at least 6 such amino acids, and more usually at least 8–10 such amino acids. Methods for determining the amino acids which make up an epitope include x-ray crystallography, 2-dimensional nuclear magnetic resonance, and epitope mapping e.g. the Pepscan method described by Geysen et al. 1984; PCT Publication No. WO 84/03564; and PCT Publication No. WO 84/03506.

Variants and Fragments

The invention also relates to variants and fragments of the polynucleotides described herein, particularly of a nucleotide sequence of SEQ ID Nos. 1 to 17, 24, 25, 28, 74 and 79 to 132, and particularly of a nucleotide sequence of SEQ ID Nos. 1 to 17, 24, 25, 28, 74 and 79 to 132 containing one or more biallelic markers and/or other polymorphisms according to the invention.

Variants of polynucleotides, as the term is used herein, are polynucleotides that differ from a reference polynucleotide. A variant of a polynucleotide may be a naturally occurring variant such as a naturally occurring allelic variant, or it may be a variant that is not known to occur naturally. Such non-naturally occurring variants of the polynucleotide may be made by mutagenesis techniques, including those applied to polynucleotides, cells or organisms. Generally, differences are limited so that the nucleotide sequences of the reference and the variant are closely similar overall and, in many regions, identical.

Variants of polynucleotides according to the invention include, without being limited to, nucleotide sequences which are at least 95% identical to a polynucleotide selected from the group consisting of the nucleotide sequences SEQ ID Nos. 1 to 17, 24, 25, 28, 74 and 79 to 132 or to any polynucleotide fragment of at least 8 consecutive nucleotides of a polynucleotide selected from the group consisting of the nucleotide SEQ ID Nos. 1 to 17, 24, 25, 28, 74 and 79 to 132, and preferably at least 99% identical, more particularly at least 99.5% identical, and most preferably at least 99.8% identical to a polynucleotide selected from the group consisting of the nucleotide SEQ ID Nos. 1 to 17, 24, 25, 28, 74 and 79 to 132 or to any polynucleotide fragment of at least 30, 35, 40, 50, 70, 80, 100, 250, 500, 1000 or 2000, to the extent that the length is consistent with the particular sequence ID, consecutive nucleotides of a polynucleotide selected from the group consisting of the nucleotide sequences of SEQ ID Nos. 1 to 17, 24, 25, 28, 74 and 79 to 132.

Nucleotide changes present in a variant polynucleotide may be silent, which means that they do not alter the amino acids encoded by the polynucleotide. However, nucleotide changes may also result in amino acid substitutions, additions, deletions, fusions and truncations in the polypeptide encoded by the reference sequence. The substitutions, deletions or additions may involve one or more nucleotides. The variants may be altered in coding or non-coding regions or both. Alterations in the coding regions may produce conservative or non-conservative amino acid substitutions, deletions or additions.

A polynucleotide fragment is a polynucleotide having a sequence that is entirely the same as part but not all of a given nucleotide sequence, preferably the nucleotide sequence of a g35030 polynucleotide, and variants thereof, or of a polynucleotide of any of SEQ ID Nos 1 to 17, 24, 25, 28, 74 and 79 to 132, or a polynucleotide comprising one of the biallelic markers A1 to A127, or the complements thereof. Such fragments may be "free-standing", i.e. not part of or fused to other polynucleotides, or they may be comprised within a single larger polynucleotide of which they form a part or region. Indeed, several of these fragments may be present within a single larger polynucleotide. Optionally, such fragments may comprise, consist of, or consist essentially of a contiguous span of at least 8, 10, 12, 15, 18, 20, 25, 30, 35, 40, 50, 70, 80, 100, 250, 500, 1000 or 2000 nucleotides in length of any of SEQ ID Nos 1 to 17, 24, 25, 28, 74 and 79 to 132.

Identity Between Nucleic Acids or Polypeptides

The terms "percentage of sequence identity" and "percentage homology" are used interchangeably herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Homology is evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, Proc. Natl. Acad. Sci. USA 85(8):2444–2448; Altschul et al., 1990, J. Mol. Biol. 215(3):403–410; Thompson et al., 1994, Nucleic Acids Res. 22(2):4673–4680; Higgins et al., 1996, Methods Enzymol. 266:383–402; Altschul et al., 1990, J. Mol. Biol. 215(3):403–410; Altschul et al., 1993, Nature Genetics 3:266–272). In a particularly preferred embodiment, protein and nucleic acid sequence homologies are evaluated using the Basic Local Alignment Search Tool ("BLAST") which is well known in the art (see, e.g., Karlin and Altschul, 1990, Proc. Natl. Acad. Sci. USA 87:2267–2268; Altschul et al., 1990, J. Mol. Biol. 215:403–410; Altschul et al., 1993, Nature Genetics 3:266–272; Altschul et al., 1997, Nuc. Acids Res. 25:3389–3402). In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992, Science 256:1443–1445; Henikoff and Henikoff, 1993, Proteins 17:49–61). Less preferably, the PAM or PAM250 matrices may also be used (see, e.g., Schwartz and Dayhoff, eds., 1978, Matrices for Detecting Distance Relationships: Atlas of Protein Sequence and Structure, Washington: National Biomedical Research Foundation). The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990, Proc. Natl. Acad. Sci. USA 87:2267–2268).

The BLAST programs may be used with the default parameters or with modified parameters provided by the user.

Stringent Hybridization Conditions

By way of example and not limitation, procedures using conditions of high stringency are as follows: prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 $\mu$g/ml denatured salmon sperm DNA. Filters are hybridized for 48 h at 65° C., the preferred hybridization temperature, in prehybridization mixture containing 100 $\mu$g/ml denatured salmon sperm DNA and 5–20× $10^6$ cpm of $^{32}$P-labeled probe. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Following the wash steps, the hybridized probes are detectable by autoradiography. Other conditions of high stringency which may be used are well known in the art and as cited in Sambrook et al., 1989; and Ausubel et al., 1989. These hybridization conditions are suitable for a nucleic acid molecule of about 20 nucleotides in length. There is no need to say that the hybridization conditions described above are to be adapted according to the length of the desired nucleic acid, following techniques well known to the one skilled in the art. The suitable hybridization conditions may for example be adapted according to the teachings disclosed in the book of Hames and Higgins (1985) or in Sambrook et al.(1989).

Genomic Sequences of g35030 Polynucleotides

The present invention concerns genomic DNA sequences of the g35030 gene. As referred to herein, genomic sequences of g35030 are indicated by nucleotide position in the 5' to 3' orientation on SEQ ID No 1.

Particularly preferred nucleic acids of the invention include isolated, purified, or recombinant polynucleotides comprising, consisting essentially of, or consisting of a contiguous span of at least 12, 15, 18, 20, 25, 30, 35, 40, 50, 60, 70, 80, 90, 100, 150, 200, 500, or 1000 nucleotides of nucleotide positions 201123 to 247802 of SEQ ID No 1, or the complements thereof. Also encompassed are purified, isolated, or recombinant polynucleotides comprising a nucleotide sequence having at least 70, 75, 80, 85, 90, or 95% nucleotide identity with nucleotide positions 201123 to 247802 of SEQ ID No 1, or a complementary sequence thereto or a fragment thereof. Also encompassed are purified, isolated, or recombinant nucleic acids that hybridize with said span under stringent hybridization conditions as defined above. Nucleic acids of the invention encompass g35030 nucleic acids from any source, including primate, non-human primate, mammalian and human.

The human g35030 gene comprises exons selected from at least 14 different exons or exon forms, referred to herein as exons S, S2, T, U, V, V1, V2, V3, V4, W, W2, X, Y, Z. As indicated in Table 1, exons V and V2 are considered alternative exons, containing overlapping sequence. Likewise, exon W2 contains overlapping sequence with exons W and X.

Figure 1:
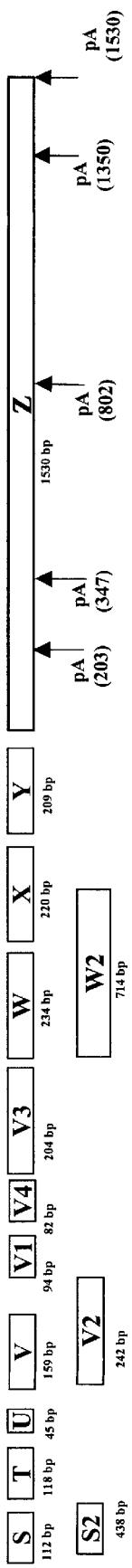
FIG. 1 is a diagram showing the exon structure of the g35030 gene.

The nucleotide positions of g35030 exons in SEQ ID No. 1 are detailed below in Table 1. The exon structure of the g35030 gene is further shown in FIG. 1.

TABLE 1

| Exon | Position in SEQ ID 1 | | Intron Position in SEQ ID 1 | |
| --- | --- | --- | --- | --- |
| S | 201123 | 201234 | 201235 | 201122 |
| S2 | 201123 | 201560 | 201561 | 214675 |
| T | 214676 | 214793 | 214794 | 215701 |
| U | 215702 | 215746 | 215747 | 216835 |
| V | 216836 | 216994 | 216995 | 217670 |
| V2 | 216836 | 217077 | 217078 | 217670 |
| V1 | 217671 | 217764 | 217765 | 227654 |
| V4 | 227655 | 227736 | 227737 | 238714 |
| V3 | 238715 | 238919 | 238920 | 240439 |
| W | 240440 | 240673 | 240674 | 244352 or 241071 |
| W2 | 240440 | 241153 | 241154 | 244352 |
| X | 241072 | 241291 | 241292 | 244352 |
| Y | 244353 | 244561 | 244562 | 246272 |
| Z | 246273 | 247802 | | |

Thus, the invention embodies purified, isolated, or recombinant polynucleotides comprising a nucleotide sequence selected from the group consisting of the exons of the g35030 gene, or a sequence complementary thereto. Preferred are purified, isolated, or recombinant polynucleotides comprising at least one exon having the nucleotide position ranges listed in Table 1 selected from the group consisting of the exons S, S2, T, U, V, V1, V2, V3, V4, W, W2, X, Y, Z of the g35030 gene, or a complementary sequence thereto or a fragment or a variant thereof. Also encompassed by the invention are purified, isolated, or recombinant nucleic acids comprising a combination of at least two exons of the g35030 gene selected from the group consisting of exons S, S2, T, U, V, V1, V2, V3, V4, W, W2, X, Y, Z, wherein the polynucleotides are arranged within the nucleic acid in the same relative order as in SEQ ID No. 1.

Particularly preferred nucleic acids of the invention include isolated, purified, or recombinant polynucleotides comprising a contiguous span of at least 12, 15, 18, 20, 25, 30, 35, 40, 45, 50, 55, 60, 65, 70, 75, 80, 90, 100 or 200 nucleotides of SEQ ID No 1, wherein said contiguous span comprises at least 1, 2, 3, 5, or 10 of the following nucleotide positions of SEQ ID No 1: 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561 and 246273 to 247802, or the complements thereof.

Another object of the invention consists of a purified, isolated, or recombinant nucleic acid that hybridizes with a g35030 nucleotide sequence of nucleotide positions 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561 and 246273 to 247802 of SEQ ID No 1, or a complementary sequence thereto or a variant thereof, under stringent hybridization conditions as defined above.

The invention also encompasses a purified, isolated, or recombinant polynucleotide comprising a nucleotide sequence of g35030.having at least 70, 75, 80, 85, 90, or 95% nucleotide identity with a sequence selected from the group consisting of nucleotide positions 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561 and 246273 to 247802 of SEQ ID No. 1 or a complementary sequence thereto or a fragment thereof. The nucleotide differences as regards the nucleotide positions 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561 and 246273 to 247802 of SEQ ID No. 1 may generally be distributed throughout the nucleic acid.

The present invention further embodies purified, isolated, or recombinant polynucleotides comprising a nucleotide sequence selected from the group consisting of the introns of the g35030 gene, or a sequence complementary thereto. The present invention thus encompasses the g35030 gene as well as g35030 genomic sequences consisting of, consisting essentially of, or comprising the sequence of nucleotide positions 201235 to 201122, 201561 to 214675, 214794 to 215701, 215747 to 216835, 216995 to 217670, 217078 to 217670, 217765 to 227654, 227737 to 238714, 238920 to 240439, 240674 to 244352, 240674 to 241071, 241154 to 244352, 241292 to 244352 and 244562 to 246272 of SEQ ID No 1, a sequence complementary thereto, as well as fragments and variants thereof.

These nucleic acids, as well as their fragments and variants, may be used as oligonucleotide primers or probes in order to detect the presence of a copy of a gene comprising a g35030 nucleic acid sequence in a test sample, or alternatively in order to amplify a target nucleotide sequence within a g35030 nucleic acid sequence or adjoining region.

Additional preferred nucleic acids of the invention include isolated, purified, or recombinant g35030 polynucleotides comprising a contiguous span of at least 12, 15, 18, 20, 25, 30, 35, 40, 45, 50, 55, 60, 65, 70, 75, 80, 90, 100 or 200 nucleotides of nucleotide positions 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561, 246273 to 247802, 201123 to 247802, 199122 to 201122, 247803 to 249803 and 199122 to 249803 of SEQ ID No 1, or the complements thereof, wherein said contiguous span comprises at least one biallelic marker. Optionally, said contiguous span comprises a g35030-related biallelic marker. It should be noted that nucleic acid fragments of any size and sequence may also be comprised by the polynucleotides described in this section. Either the original or the alternative allele may be present at said biallelic marker.

As noted above, g35030 gene sequence are indicated by position on SEQ ID No1. Accordingly, in certain embodiments, a g35030 nucleotide sequence may also comprise isolated, purified, or recombinant polynucleotides comprising a contiguous span of at least 12, 15, 18, 20, 25, 30, 35, 40, 50, 60, 70, 80, 90, 100, 150, 200, 500, 1000 or 2000 nucleotides of nucleotide positions 31 to 319608 of SEQ ID No. 1, or the complements thereof. Optionally, said contiguous span comprises a biallelic marker selected from the group consisting of A13 to A18, A20 to A47, A50 to A53, A56, A58, and A60 to A64. Optionally allele 2 is present at the biallelic marker. It should be noted that nucleic acid fragments of any size and sequence may be comprised by the polynucleotides described in this section.

Further nucleic acids of the invention include isolated, purified, or recombinant polynucleotides comprising a contiguous span of at least 12, 15, 18, 20, 25, 30, 35, 40, 50, 60, 70, 80, 90, 100, 150, 200, 300, 400 or 500 nucleotides, to the extent that the length of said span is consistent with the length of the SEQ ID, of SEQ ID Nos. 24, 25, 28 and 74. The invention also encompasses a purified, isolated, or recombinant polynucleotide comprising a nucleotide sequence having at least 70, 75, 80, 85, 90, or 95% nucleotide identity to said span, as well as a purified, isolated, or recombinant nucleic acid that hybridizes with a said span under the stringent hybridization conditions as defined above. Optionally, said contiguous span comprises ar biallelic marker selected from the group consisting of A73 to A74, A77 and A124. Optionally allele 2 is present at the biallelic marker. It should be noted that nucleic acid fragments of any size and sequence may be comprised by the polynucleotides described in this section.

Yet further nucleic acids of the invention include isolated, purified, or recombinant polynucleotides comprising a contiguous span of at least 12, 15, 18, 20, 25, 30, 35, 40, 50, 60, 70, 80, 90, 100, 150, 200, 500 or 1000 nucleotides, to the extent that said span is consistent with the nucleotide position range, of SEQ ID No 1, wherein said contiguous span comprises at least 1, 2, 3, 5, or 10 of the following nucleotide positions of SEQ ID No 1: 201188 to 201234, 216836 to 216915 and 246273 to 247781, or the complements thereof, as well as polynucleotides having at least 70, 75, 80, 85, 90, or 95% nucleotide identity with said span, and polynucleotides capable of hybridizing with said span. In other embodiments, said contiguous span may specifically exclude one or more of the following nucleotide positions of SEQ ID No. 1: 201188 to 201234, 216836 to 216915, 214676 to 214793 and 215702 to 215746.

The present invention also comprises a purified or isolated nucleic acid encoding a g35030 protein having the amino acid sequence of any one of SEQ ID Nos 18 to 23 or a peptide fragment or variant thereof.

It should be noted that nucleic acid fragments of any size and sequence may also be comprised by the polynucleotides described in this section.

While this section is entitled "Genomic Sequences of g35030," it should be noted that nucleic acid fragments of any size and sequence may also be comprised by the polynucleotides described in this section, flanking the genomic sequences g35030 on either side or between two or more such genomic sequences.

g35030 cDNA Sequences

The expression of the g35030 gene has been shown to lead to the production of several mRNA species. Several cDNA sequences corresponding to these mRNA are set forth in SEQ ID Nos 2to 17.

The invention encompasses a purified, isolated, or recombinant nucleic acid comprising a nucleotide sequence selected from the group consisting of SEQ ID Nos 2 to 17, complementary sequences thereto, splice variants thereof, as well as allelic variants, and fragments thereof. Moreover, preferred polynucleotides of the invention include purified, isolated, or recombinant g35030 cDNAs consisting of, consisting essentially of, or comprising a nucleotide sequence selected from the group consisting of SEQ ID Nos 2 to 17. Particularly preferred nucleic acids of the invention include isolated, purified, or recombinant polynucleotides comprising a contiguous span of at least 8, 12, 15, 18, 20, 25, 30, 35, 40, 50, 60, 70, 75, 80, 100, 200, 500 or 1000 nucleotides, to the extent that the length of said contiguous span is consistent with the length of the SEQ ID, of a nucleotide sequence selected from the group consisting of SEQ ID Nos 2 to 17, or the complements thereof.

It should be noted that nucleic acid fragments of any size and sequence may also be comprised by the polynucleotides described in this section.

The invention also pertains to a purified or isolated nucleic acid comprising a polynucleotide having at least 70, 80, 85, 90 or 95% nucleotide identity with a polynucleotide selected from the group consisting of SEQ ID Nos 2 to 17, advantageously 99% nucleotide identity, preferably 99.5% nucleotide identity and most preferably 99.8% nucleotide identity with a polynucleotide selected from the group consisting of SEQ ID Nos 2 to 17, or a sequence complementary thereto or a biologically active fragment thereof.

Another object of the invention relates to purified, isolated or recombinant nucleic acids comprising a polynucleotide that hybridizes, under the stringent hybridization conditions defined herein, with a polynucleotide selected from the group consisting of SEQ ID Nos 2 to 17, or a sequence complementary thereto or a variant thereof or a biologically active fragment thereof.

The g35030 cDNA forms of SEQ ID Nos 2 to 17 are further described in Table 2 below. Shown on the Table 2 are the positions of the 5' UTR, the open reading frame (ORF), the 3' UTR and the polyA signal on the respective SEQ ID No. Also shown are the g35030 exons comprising the cDNA form of a particular SEQ ID No.

TABLE 2

| cDNA | SEQ ID No of cDNA | Position range of 5' UTR in SEQ ID | | Position range of ORF in SEQ ID | | Position range of 3' UTR in SEQ ID | | Position range of polyA signal in SEQ ID | |
|---|---|---|---|---|---|---|---|---|---|
| VV1WYZ | 2 | 1 | 95 | 96 | 167 | 168 | 2226 | 2200 | 2205 |
| VV1V3WYZ | 3 | 1 | 95 | 96 | 167 | 168 | 2431 | 2405 | 2410 |
| V2WYZ | 4 | 1 | 95 | 96 | 311 | 312 | 2215 | 2189 | 2194 |
| VWYZ | 5 | 1 | 95 | 96 | 212 | 213 | 2132 | 2106 | 2111 |
| V2YZ | 6 | 1 | 95 | 96 | 260 | 261 | 1981 | 1955 | 1960 |
| VV1YZ | 7 | 1 | 95 | 96 | 167 | 168 | 1992 | 1966 | 1971 |
| VYZ | 8 | 1 | 95 | 96 | 182 | 183 | 1898 | 1872 | 1877 |
| VV1Z | 9 | 1 | 95 | 96 | 167 | 168 | 1783 | 1757 | 1762 |
| V2V1WYZ | 10 | 1 | 95 | 96 | 311 | 312 | 2309 | 2283 | 2288 |
| V2V1YZ | 11 | 1 | 95 | 96 | 311 | 312 | 2075 | 2049 | 2054 |
| VWZ | 12 | 1 | 95 | 96 | 212 | 213 | 1923 | 1897 | 1902 |
| VV1V4WYZ | 13 | 1 | 95 | 96 | 167 | 168 | 2308 | 2282 | 2287 |
| VV1W2YZ | 14 | 1 | 95 | 96 | 167 | 168 | 2706 | 2680 | 2685 |
| VW2YZ | 15 | 1 | 95 | 96 | 212 | 213 | 2612 | 2586 | 2591 |
| STUV | 16 | 1 | 370 | 371 | 436 | 437 | 434 | — | — |
| S2TUV | 17 | 1 | 696 | 697 | 762 | 763 | 760 | — | — |

The present invention thus further encompasses variant g35030 polynucleotides having at least one nucleotide substitution, insertion or deletion as described further herein. In preferred embodiments described in Table 3, the invention comprises g35030 polynucleotides comprising a variation as described herein by biallelic markers 8-126-286 (also referred to as 8-130-143) and 8-155-258. The invention thus encompasses purified, isolated, or recombinant polynucleotides and polypeptides encoded thereby, wherein the polynucleotides comprise a contiguous span of at least 8, 12, 15, 18, 20, 25, 30, 35, 40, 45, 50, 60, 70, 80, 100, 150, or 200 nucleotides of SEQ ID No 2 to 17 or the complement thereof, wherein said contiguous span further comprises nucleotide position 132 of any of SEQ ID Nos 2 to 15 and 17, or nucleotide position 407 of SEQ ID No 16. Optionally, an A is present at said nucleotide position; optionally a G is present at said nucleotide position. In a further embodiment, said contiguous span comprises nucleotide position 328 or SEQ ID 3, or the complement thereof, and optionally a C is present at said position, or optionally a T is present at said position.

While this section is entitled "g35030 cDNA Sequences," it should be noted that nucleic acid fragments of any size and sequence may also be comprised by the polynucleotides described in this section, flanking the genomic sequences of g35030 on either side or between two or more such genomic sequences.

G35030 Coding Regions

The g35030 open reading frame is contained in the corresponding mRNA of a cDNA sequence selected from the group consisting of SEQ ID Nos 2 to 17. The effective g35030 coding sequence (CDS) may include several forms as indicated above, in some embodiments encompassing isolated, purified, and recombinant polynucleotides which encode a polypeptide comprising a contiguous span of at least 4 amino acids, preferably 6, more preferably at least 8 or 10 amino acids, yet more preferably at least 12, 15, 20, 25, 30, 40, 50, or 100 amino acids of SEQ ID Nos 18 to 23. The effective g35030 coding sequence (CDS) may comprise the region between the first nucleotide of the ATG codon and the end nucleotide of the stop codon of SEQ ID Nos 2 to 17 as indicated in Table 2 above.

TABLE 3

| SEQ ID No | cDNA form | Polymorphism reference | Alleles | | Position in SEQ ID No 1 | Position in SEQ ID No of cDNA | Position in amino acid seq |
|---|---|---|---|---|---|---|---|
| 2 | V1WYZ | 8-126-286/ 8-130-143 | A | G | 216967 | 132 | 13 |
| 3 | VV1V3WYZ | | | | | 132 | 13 |
| 4 | V2WYZ | | | | | 132 | 13 |
| 5 | VWYZ | | | | | 132 | 13 |
| 6 | V2YZ | | | | | 132 | 13 |
| 7 | VV1YZ | | | | | 132 | 13 |
| 8 | VYZ | | | | | 132 | 13 |
| 9 | VV1Z | | | | | 132 | 13 |
| 10 | V2V1WYZ | | | | | 132 | 13 |
| 11 | V2V1YZ | | | | | 132 | 13 |
| 12 | VWZ | | | | | 132 | 13 |
| 13 | VV1V4WYZ | | | | | 132 | 13 |
| 14 | VV1W2YZ | | | | | 132 | 13 |
| 15 | VW2YZ | | | | | 132 | 13 |
| 16 | STUV | | | | | 407 | 13 |
| 17 | S2TUV | | | | | 733 | 13 |
| 3 | VV1V3WYZ | 8-155-258 | C | T | 238789 | VV1V3WYZ:328 | — |

The above disclosed polynucleotide that contains the coding sequence of the g35030 gene may be expressed in a desired host cell or a desired host organism when this polynucleotide is placed under the control of suitable expression signals. The expression signals may be either the expression signals contained in the regulatory regions in the g35030 gene of the invention or in contrast the signals may be exogenous regulatory nucleic sequences. Such a polynucleotide, when placed under the suitable expression signals, may also be inserted in a vector for its expression and/or amplification.

Regulatory Sequences of g35030

As mentioned, the genomic sequence of the g35030 gene contains regulatory sequences both in the non-coding 5'-flanking region and in the non-coding 3'-flanking region that border the g35030 coding region containing the exons of the gene.

Polynucleotides derived from the 5' and 3' regulatory regions are useful in order to detect the presence of at least a copy of a g35030 nucleotide sequence of SEQ ID No 1 or a fragment thereof in a test sample.

The promoter activity of the 5' regulatory regions contained in g35030 can be assessed as described below.

In order to identify the relevant biologically active polynucleotide fragments or variants of a g35030 regulatory region, one of skill in the art will refer to Sambrook et al.(1989), which describes the use of a recombinant vector carrying a marker gene (i.e. beta galactosidase, chloramphenicol acetyl transferase, etc.) the expression of which will be detected when placed under the control of a biologically active polynucleotide fragment or variant of the g35030 sequence of SEQ ID No 1. Genomic sequences located upstream of the first exon of the g35030 gene are cloned into a suitable promoter reporter vector, such as the pSEAP-Basic, pSEAP-Enhancer, pβgal-Basic, pβgal-Enhancer, or pEGFP-1 Promoter Reporter vectors available from Clontech, or pGL2-basic or pGL3-basic promoterless luciferase reporter gene vector from Promega. Briefly, each of these promoter reporter vectors include multiple cloning sites positioned upstream of a reporter gene encoding a readily assayable protein such as secreted alkaline phosphatase, luciferase, β galactosidase, or green fluorescent protein. The sequences upstream of the g35030 coding region are inserted into the cloning sites upstream of the reporter gene in both orientations and introduced into an appropriate host cell. The level of reporter protein is assayed and compared to the level obtained from a vector which lacks an insert in the cloning site. The presence of an elevated expression level in the vector containing the insert with respect to the control vector indicates the presence of a promoter in the insert. If necessary, the upstream sequences can be cloned into vectors which contain an enhancer for increasing transcription levels from weak promoter sequences. A significant level of expression above that observed with the vector lacking an insert indicates that a promoter sequence is present in the inserted upstream sequence.

Promoter sequence within the upstream genomic DNA may be further defined by constructing nested 5' and/or 3' deletions in the upstream DNA using conventional techniques such as Exonuclease III or appropriate restriction endonuclease digestion. The resulting deletion fragments can be inserted into the promoter reporter vector to determine whether the deletion has reduced or obliterated promoter activity, such as described, for example, by Coles et al.(1998). In this way, the boundaries of the promoters may be defined. If desired, potential individual regulatory sites within the promoter may be identified using site directed mutagenesis or linker scanning to obliterate potential transcription factor binding sites within the promoter individually or in combination. The effects of these mutations on transcription levels may be determined by inserting the mutations into cloning sites in promoter reporter vectors. This type of assay is well-known to those skilled in the art and is described in WO 97/17359, U.S. Pat. No. 5,374,544; EP 582 796; U.S. Pat. Nos. 5,698,389; 5,643,746; 5,502, 176; and 5,266,488.

The strength and the specificity of the promoter of the g35030 gene can be assessed through the expression levels of a detectable polynucleotide operably linked to the g35030 promoter in different types of cells and tissues. The detectable polynucleotide may be either a polynucleotide that specifically hybridizes with a predefined oligonucleotide probe, or a polynucleotide encoding a detectable protein, including a g35030 polypeptide or a fragment or a variant thereof. This type of assay is well-known to those skilled in the art and is described in U.S. Pat. Nos. 5,502,176; and 5,266,488. Some of the methods are discussed in more detail below.

Polynucleotides carrying the regulatory elements located at the 5' end and at the 3' end of the g35030 coding region may be advantageously used to control the transcriptional and translational activity of an heterologous polynucleotide of interest.

Thus, the present invention also concerns a purified or isolated nucleic acid comprising a polynucleotide which is selected from the group consisting of the 5' and 3' regulatory regions of g35030, or a sequence complementary thereto or a biologically active fragment or variant thereof. In one aspect, "5' regulatory region" may comprise the nucleotide sequence located between positions 199122 to 201122 of SEQ ID No 1. In one aspect, "3' regulatory region" may comprise the nucleotide sequence located between positions 247803 to 249803 of SEQ ID No 1.

The invention also pertains to a purified or isolated nucleic acid comprising a polynucleotide having at least 95% nucleotide identity with a polynucleotide selected from the group consisting of the 5' and 3' regulatory regions, advantageously 99% nucleotide identity, preferably 99.5% nucleotide identity and most preferably 99.8% nucleotide identity with a polynucleotide selected from the group consisting of the 5' and 3' regulatory regions, or a sequence complementary thereto or a variant thereof or a biologically active fragment thereof.

Another object of the invention consists of purified, isolated or recombinant nucleic acids comprising a polynucleotide that hybridizes, under the stringent hybridization conditions defined herein, with a polynucleotide selected from the group consisting of the nucleotide sequences of the 5'- and 3' regulatory regions of g35030, or a sequence complementary thereto or a variant thereof or a biologically active fragment thereof.

Preferred fragments of the 5' regulatory region have a length of about 1500 or 1000 nucleotides, preferably of about 500 nucleotides, more preferably about 400 nucleotides, even more preferably 300 nucleotides and most preferably about 200 nucleotides.

Preferred fragments of the 3' regulatory region are at least 50, 100, 150, 200, 300 or 400 bases in length.

"Biologically active" g35030 regulatory polynucleotide derivatives of SEQ ID No 1 are polynucleotides comprising or alternatively consisting in a fragment of said polynucleotide which is functional as a regulatory region for expressing a recombinant polypeptide or a recombinant polynucleotide in a recombinant cell host. It could act either as an enhancer or as a repressor.

For the purpose of the invention, a nucleic acid or polynucleotide is "functional" as a regulatory region for expressing a recombinant polypeptide or a recombinant polynucleotide if said regulatory polynucleotide contains nucleotide sequences which contain transcriptional and translational regulatory information, and such sequences are "operably linked" to nucleotide sequences which encode the desired polypeptide or the desired polynucleotide.

The regulatory polynucleotides of the invention may be prepared from the nucleotide sequence of SEQ ID No 1 by cleavage using suitable restriction enzymes, as described for example in Sambrook et al.(1989). The regulatory polynucleotides may also be prepared by digestion of SEQ ID No 1 by an exonuclease enzyme, such as Bal31 (Wabiko et al., 1986). These regulatory polynucleotides can also be prepared by nucleic acid chemical synthesis, as described elsewhere in the specification.

The g35030 regulatory polynucleotides according to the invention may be part of a recombinant expression vector that may be used to express a coding sequence in a desired host cell or host organism. The recombinant expression vectors according to the invention are described elsewhere in the specification.

A preferred 5'-regulatory polynucleotide of the invention includes the 5'-untranslated region (5'-UTR) of the g35030 cDNA, or a biologically active fragment or variant thereof.

A preferred 3'-regulatory polynucleotide of the invention includes the 3'-untranslated region (3'-UTR) of the g35030 cDNA, or a biologically active fragment or variant thereof.

A further object of the invention consists of a purified or isolated nucleic acid comprising:

a) a nucleic acid comprising a regulatory nucleotide sequence selected from the group consisting of:
  (i) a nucleotide sequence comprising a polynucleotide of the g35030 5' regulatory region or a complementary sequence thereto;
  (ii) a nucleotide sequence comprising a polynucleotide having at least 95% of nucleotide identity with the nucleotide sequence of the g35030 5' regulatory region or a complementary sequence thereto;
  (iii) a nucleotide sequence comprising a polynucleotide that hybridizes under stringent hybridization conditions with the nucleotide sequence of the g35030 5' regulatory region or a complementary sequence thereto; and
  (iv) a biologically active fragment or variant of the polynucleotides in (i), (ii) and (iii);
b) a polynucleotide encoding a desired polypeptide or a nucleic acid of interest, operably linked to the nucleic acid defined in (a) above; and
c) optionally, a nucleic acid comprising a 3'- regulatory polynucleotide, preferably a 3'-regulatory polynucleotide of the g35030 gene.

In a specific embodiment of the nucleic acid defined above, said nucleic acid includes the 5'-untranslated region (5'-UTR) of the g35030 cDNA, or a biologically active fragment or variant thereof.

In a second specific embodiment of the nucleic acid defined above, said nucleic acid includes the 3'-untranslated region (3'-UTR) of the g35030 cDNA, or a biologically active fragment or variant thereof.

The regulatory polynucleotide of the 5' regulatory region, or its biologically active fragments or variants, is operably linked at the 5'-end of the polynucleotide encoding the desired polypeptide or polynucleotide.

The regulatory polynucleotide of the 3' regulatory region, or its biologically active fragments or variants, is advantageously operably linked at the 3'-end of the polynucleotide encoding the desired polypeptide or polynucleotide.

The desired polypeptide encoded by the above-described nucleic acid may be of various nature or origin, encompassing proteins of prokaryotic or eukaryotic origin. Among the polypeptides expressed under the control of a g35030 regulatory region include bacterial, fungal or viral antigens. Also encompassed are eukaryotic proteins such as intracellular proteins, like "house keeping" proteins, membrane-bound proteins, like receptors, and secreted proteins like endogenous mediators such as cytokines. The desired polypeptide may be the g35030 protein, especially the protein of the amino acid sequences of SEQ ID Nos 18 to 23, or a fragment or a variant thereof.

The desired nucleic acids encoded by the above-described polynucleotide, usually an RNA molecule, may be complementary to a desired coding polynucleotide, for example to the g35030 coding sequence, and thus useful as an antisense polynucleotide.

Such a polynucleotide may be included in a recombinant expression vector in order to express the desired polypeptide or the desired nucleic acid in host cell or in a host organism. Suitable recombinant vectors that contain a polynucleotide such as described herein are disclosed elsewhere in the specification.

Polynucleotide Constructs

The terms "polynucleotide construct" and "recombinant polynucleotide" are used interchangeably herein to refer to linear or circular, purified or isolated polynucleotides that have been artificially designed and which comprise at least two nucleotide sequences that are not found as contiguous nucleotide sequences in their initial natural environment. It should be noted that the present invention embodies recombinant vectors comprising any one of the polynucleotides described in the present invention.

DNA Constructs that Enables Directing Temporal and Spatial Expression of g35030 Nucleic Acid Sequences in Recombinant Cell Hosts and in Transgenic Animals In order to study the physiological and phenotypic consequences of a lack of synthesis of a protein encoded by a nucleotide sequence comprising a g35030 polynucleotide, both at the cell level and at the multi cellular organism level, the invention also encompasses DNA constructs and recombinant vectors enabling a conditional expression of a specific allele of a nucleotide sequence comprising a g35030 polynucleotide and also of a copy of a sequence comprising a nucleotide sequence of a g35030 polynucleotide, or a fragment thereof, harboring substitutions, deletions, or additions of one or more bases. These base substitutions, deletions or additions may be located either in an exon, an intron or a regulatory sequence, in particular a 5' regulatory sequence of a g35030 polynucleotide. In a preferred embodiment, the nucleotide sequence comprising a g35030 polynucleotide further comprises a biallelic marker of the present invention.

A first preferred DNA construct is based on the tetracycline resistance operon tet from E. coli transposon Tn110 for controlling the expression of a g35030 polynucleotide, such as described by Gossen et al. (1992, 1995) and Furth et al.(1994). Such a DNA construct contains seven tet operator sequences from Tn10 (tetop) that are fused to either a minimal promoter or a 5'-regulatory sequence of the g35030 polynucleotide, said minimal promoter or said g35030 polynucleotide regulatory sequence being operably linked to a polynucleotide of interest that codes either for a sense or an antisense oligonucleotide or for a polypeptide, including a g35030 polynucleotide-encoded polypeptide or a peptide fragment thereof. This DNA construct is functional as a conditional expression system for the nucleotide sequence of interest when the same cell also comprises a nucleotide sequence coding for either the wild type (tTA) or the mutant (rTA) repressor fused to the activating domain of viral protein VP16 of herpes simplex virus, placed under the control of a promoter, such as the HCMVIE1 enhancer/promoter or the MMTV-LTR. Indeed, a preferred DNA construct of the invention comprises both the polynucleotide containing the tet operator sequences and the polynucleotide containing a sequence coding for the tTA or the rTA repressor.

In a specific embodiment, the conditional expression DNA construct contains the sequence encoding the mutant tetracycline repressor rTA, the expression of the polynucleotide of interest is silent in the absence of tetracycline and induced in its presence.

DNA Constructs Allowing Homologous Recombination: Replacement Vectors

A second preferred DNA construct will comprise, from 5'-end to 3'-end: (a) a first nucleotide sequence comprising a g35030 polynucleotide; (b) a nucleotide sequence comprising a positive selection marker, such as the marker for neomycine resistance (neo); and (c) a second nucleotide sequence comprising a respective g35030 polynucleotide, and is located on the genome downstream of the first g35030 polynucleotide sequence (a).

In a preferred embodiment, this DNA construct also comprises a negative selection marker located upstream the nucleotide sequence (a) or downstream the nucleotide sequence (c). Preferably, the negative selection marker comprises the thymidine kinase (tk) gene (Thomas et al., 1986), the hygromycine beta gene (Te Riele et al., 1990), the hprt gene (Van der Lugt et al., 1991; Reid et al., 1990) or the Diphteria toxin A fragment (Dt-A) gene (Nada et al., 1993; Yagi et al.1990). Preferably, the positive selection marker is located within and exon of a g35030 polynucleotide so as to interrupt the sequence encoding the g35030 protein. These replacement vectors are described, for example, by Thomas et al.(1986; 1987), Mansour et al.(1988) and Koller et al.(1992).

The first and second nucleotide sequences (a) and (c) may be indifferently located within a g35030 polynucleotide regulatory sequence, an intronic sequence, an exon sequence or a sequence containing both regulatory and/or intronic and/or exon sequences. The size of the nucleotide sequence of (a) and (c) ranges from 1 to 50 kb, preferably from 1 to 10 kb, more preferably from 2 to 6 kb and most preferably from 2 to 4 kb.

DNA Constructs Allowing Homologous Recombination: Cre-LoxP System

These new DNA constructs make use of the site specific recombination system of the P1 phage. The P1 phage possesses a recombinase called Cre which interacts specifically with a 34 base pairs loxP site. The loxP site is composed of two palindromic sequences of 13 bp separated by a 8 bp conserved sequence (Hoess et al., 1986). The recombination by the Cre enzyme between two loxP sites having an identical orientation leads to the deletion of the DNA fragment.

The Cre-loxP system used in combination with a homologous recombination technique has been first described by Gu et al.(1993, 1994). Briefly, a nucleotide sequence of interest to be inserted in a targeted location of the genome harbors at least two loxP sites in the same orientation and located at the respective ends of a nucleotide sequence to be excised from the recombinant genome. The excision event requires the presence of the recombinase (Cre) enzyme within the nucleus of the recombinant cell host. The recombinase enzyme may be brought at the desired time either by (a) incubating the recombinant cell hosts in a culture medium containing this enzyme, by injecting the Cre enzyme directly into the desired cell, such as described by Araki et al.(1995), or by lipofection of the enzyme into the cells, such as described by Baubonis et al.(1993); (b) transfecting the cell host with a vector comprising the Cre coding sequence operably linked to a promoter functional in the recombinant cell host, which promoter being optionally inducible, said vector being introduced in the recombinant cell host, such as described by Gu et al.(1993) and Sauer et al.(1988); (c) introducing in the genome of the cell host a polynucleotide comprising the Cre coding sequence operably linked to a promoter functional in the recombinant cell host, which promoter is optionally inducible, and said polynucleotide being inserted in the genome of the cell host either by a random insertion event or an homologous recombination event, such as described by Gu et al.(1994).

In a specific embodiment, the vector containing the sequence to be inserted in a g35030 gene sequence by homologous recombination is constructed in such a way that selectable markers are flanked by loxP sites of the same orientation, it is possible, by treatment by the Cre enzyme, to eliminate the selectable markers while leaving the g35030 polynucleotide sequences of interest that have been inserted by an homologous recombination event. Again, two selectable markers are needed: a positive selection marker to select for the recombination event and a negative selection marker to select for the homologous recombination event. Vectors and methods using the Cre-loxP system are described by Zou et al.(1994).

Thus, in one aspect, a further preferred DNA construct of the invention comprises, from 5'-end to 3'-end: (a) a first nucleotide sequence that is comprised by a g35030 polynucleotide; (b) a nucleotide sequence comprising a polynucleotide encoding a positive selection marker, said nucleotide sequence comprising additionally two sequences defining a site recognized by a recombinase, such as a loxP site, the two sites being placed in the same orientation; and (c) a second nucleotide sequence comprising a g35030 polynucleotide, and is located on the genome downstream of the first g35030 polynucleotide sequence (a).

The sequences defining a site recognized by a recombinase, such as a loxP site, are preferably located within the nucleotide sequence (b) at suitable locations bordering the nucleotide sequence for which the conditional excision is sought. In one specific embodiment, two loxP sites are located at each side of the positive selection marker sequence, in order to allow its excision at a desired time after the occurrence of the homologous recombination event.

In a preferred embodiment of a method using the third DNA construct described above, the excision of the polynucleotide fragment bordered by the two sites recognized by a recombinase, preferably two loxP sites, is performed at a desired time, due to the presence within the genome of the recombinant host cell of a sequence encoding the Cre enzyme operably linked to a promoter sequence, preferably an inducible promoter, more preferably a tissue-specific promoter sequence and most preferably a promoter sequence which is both inducible and tissue-specific, such as described by Gu et al.(1994).

The presence of the Cre enzyme within the genome of the recombinant cell host may result from the breeding of two transgenic animals, the first transgenic animal bearing the g35030 polynucleotide-derived sequence of interest containing the loxP sites as described above and the second transgenic animal bearing the Cre coding sequence operably linked to a suitable promoter sequence, such as described by Gu et al.(1994).

Spatio-temporal control of the Cre enzyme expression may also be achieved with an adenovirus based vector that contains the Cre gene thus allowing infection of cells, or in vivo infection of organs, for delivery of the Cre enzyme, such as described by Anton and Graham (1995) and Kanegae et al.(1995).

The DNA constructs described above may be used to introduce a desired nucleotide sequence of the invention, preferably a g35030 polynucleotide, and most preferably an altered copy of a g35030 polynucleotide sequence, within a predetermined location of the targeted genome, leading either to the generation of an altered copy of a targeted gene (knock-out homologous recombination) or to the replacement of a copy of the targeted gene by another copy sufficiently homologous to allow an homologous recombination event to occur (knock-in homologous recombination). In a specific embodiment, the DNA constructs described above may be used to introduce a g35030 polynucleotide.

Nuclear Antisense DNA Constructs

Other compositions containing a vector of the invention comprise an oligonucleotide fragment of the g35030 polynucleotide sequences of SEQ ID No.1 respectively, as an antisense tool that inhibits the expression of the corresponding gene. Preferred methods using antisense polynucleotide according to the present invention are the procedures described by Sczakiel et al.(1995) or those described in PCT Application No WO 95/24223.

Preferably, the antisense tools are chosen among the polynucleotides (15–200 bp long) that are complementary to the 5'end of a g35030 polynucleotide mRNA. In one embodiment, a combination of different antisense polynucleotides complementary to different parts of the desired targeted gene are used.

Preferably, the antisense polynucleotides of the invention have a 3' polyadenylation signal that has been replaced with a self-cleaving ribozyme sequence, such that RNA polymerase II transcripts are produced without poly(A) at their 3' ends, these antisense polynucleotides being incapable of export from the nucleus, such as described by Liu et al.(1994). In a preferred embodiment, these g35030 antisense polynucleotides also comprise, within the ribozyme cassette, a histone stem-loop structure to stabilize cleaved transcripts against 3'-5' exonucleolytic degradation, such as the structure described by Eckner et al.(1991).

Constructs for Activation of g35030 Gene

The present invention also encompasses primary, secondary, and immortalized homologously recombinant host cells of vertebrate origin, preferably mammalian origin and particularly human origin, that have been engineered to: a) insert exogenous (heterologous) polynucleotides into the endogenous chromosomal DNA of a targeted gene, b) delete endogenous chromosomal DNA, and/or c) replace endogenous chromosomal DNA with exogenous polynucleotides. Insertions, deletions, and/or replacements of polynucleotide sequences may be to the coding sequences of the targeted gene and/or to regulatory regions, such as promoter and enhancer sequences, operably associated with the targeted gene.

The present invention further relates to a method of making a homologously recombinant host cell in vitro or in vivo, wherein the expression of a targeted gene not normally expressed in the cell is altered. Preferably the alteration causes expression of the targeted gene under normal growth conditions or under conditions suitable for producing the polypeptide encoded by the targeted gene. The method comprises the steps of: (a) transfecting the cell in vitro or in vivo with a polynucleotide construct, the a polynucleotide construct comprising; (i) a targeting sequence; (ii) a regulatory sequence and/or a coding sequence; and (iii) an unpaired splice donor site, if necessary, thereby producing a transfected cell; and (b) maintaining the transfected cell in vitro or in vivo under conditions appropriate for homologous recombination.

The present invention further relates to a method of altering the expression of a targeted gene in a cell in vitro or in vivo wherein the gene is not normally expressed in the cell, comprising the steps of: (a) transfecting the cell in vitro or in vivo with a a polynucleotide construct, the a polynucleotide construct comprising: (i) a targeting sequence; (ii) a regulatory sequence and/or a coding sequence; and (iii) an unpaired splice donor site, if necessary, thereby producing a transfected cell; and (b) maintaining the transfected cell in vitro or in vivo under conditions appropriate for homologous recombination, thereby producing a homologously recombinant cell; and (c) maintaining the homologously recombinant cell in vitro or in vivo under conditions appropriate for expression of the gene.

The present invention further relates to a method of making a polypeptide of the present invention by altering the expression of a targeted endogenous gene in a cell in vitro or in vivo wherein the gene is not normally expressed in the cell, comprising the steps of: a) transfecting the cell in vitro with a a polynucleotide construct, the a polynucleotide construct comprising: (i) a targeting sequence; (ii) a regulatory sequence and/or a coding sequence; and (iii) an unpaired splice donor site, if necessary, thereby producing a transfected cell; (b) maintaining the transfected cell in vitro or in vivo under conditions appropriate for homologous recombination, thereby producing a homologously recombinant cell; and c) maintaining the homologously recombinant cell in vitro or in vivo under conditions appropriate for expression of the gene thereby making the polypeptide.

The present invention further relates to a a polynucleotide construct which alters the expression of a targeted gene in a cell type in which the gene is not normally expressed. This occurs when the a polynucleotide construct is inserted into the chromosomal DNA of the target cell, wherein the a polynucleotide construct comprises: a) a targeting sequence; b) a regulatory sequence and/or coding sequence; and c) an unpaired splice-donor site, if necessary. Further included are a polynucleotide constructs, as described above, wherein the contruct further comprises A a polynucleotide which encodes a polypeptide and is in-frame with the targeted endogenous gene after homologous recombination with chromosomal DNA.

The compositions may be produced, and methods performed, by techniques known in the art, such as those described in U.S. Pat. Nos: 6,054,288; 6,048,729; 6,048,724; 6,048,524; 5,994,127; 5,968,502; 5,965,125; 5,869,239; 5,817,789; 5,783,385; 5,733,761; 5,641,670; 5,580,734; International Publication Nos:WO96/2941 1, WO 94/12650; and scientific articles including 1994; Koller et al., Proc. Natl. Acad. Sci. USA 86:8932–8935 (1989) (the disclosures of each of which are incorporated by reference in their entireties).

Oligonucleotide Probes and Primers

The polynucleotides of the invention are useful in order to detect the presence of at least a copy of a g35030 nucleotide sequence of SEQ ID Nos 1 to 17 or of the respective g35030 polynucleotide or gene, or a fragment, complement, or variant thereof in a test sample.

Particularly preferred probes and primers of the invention include isolated, purified, or recombinant polynucleotides comprising a contiguous span of at least 12, 15, 18, 20, 25, 30, 35, 40, 50, 60, 70, 80, 90, 100, 150, 200, 500, 1000 or 2000 nucleotides, to the extent that said span is consistent with the length of the nucleotide position range, of SEQ ID No 1, wherein said contiguous span comprises at least 1, 2, 3, 4, 5, 7 or 10 of the following nucleotide positions of SEQ ID No 1: 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561, 246273 to 247802, 201123 to 247802, 199122 to 201122, 247803 to 249803 and 199122 to 249803, or a complementary sequence thereto or a fragment thereof.

Probes and primers of the invention also include isolated, purified, or recombinant polynucleotides having at least 70, 75, 80, 85, 90, or 95% nucleotide identity with a contiguous span of at least 12, 15, 18, 20, 25, 30, 35, 40, 50, 60, 70, 80, 90, 100, 150, 200, 500, 1000 or 2000 nucleotides of nucleotide positions 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561, 246273 to 247802, 201123 to 247802, 199122 to 201122, 247803 to 249803 and 199122 to 249803 of SEQ ID No. 1. Preferred probes and primers of the invention also include isolated, purified, or recombinant polynucleotides comprising a g35030 nucleotide sequence having at least 70, 75, 80, 85, 90, or 95% nucleotide identity with at least one sequence selected from the group consisting of the following nucleotide positions of SEQ ID No. 1: 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561, 246273 to 247802, 201123 to 247802, 199122 to 201122, 247803 to 249803 and 199122 to 249803; or a complementary sequence thereto or a fragment thereof.

The invention also relates to nucleic acid probes characterized in that they hybridize specifically, under the stringent hybridization conditions defined above, with a contiguous span of at least 12, 15, 18, 20, 25, 30, 35, 40, 50, 60, 70, 80, 90, 100, 150, 200, 500, 1000 or 2000 nucleotides of nucleotide positions 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561, 246273 to 247802, 201123 to 247802, 199122 to 201122, 247803 to 249803 and 199122 to 249803 of SEQ ID No. 1, or a variant thereof or a sequence complementary thereto.

Probes and primers of the invention further include isolated, purified, or recombinant polynucleotides comprising a contiguous span of at least 12, 15, 18, 20, 25, 30, 35, 40, 50, 60, 70, 80, 90, 100, 150, 200, 500, 1000 or 2000 nucleotides, to the extent that said span is consistent with the length of the nucleotide position range, of SEQ ID No 2 to 17 or 79 to 132. Also included are isolated, purified, or recombinant polynucleotides having at least 70, 75, 80, 85, 90, or 95% nucleotide identity with a contiguous span of at least 12, 15, 18, 20, 25, 30, 35, 40, 50, 60, 70, 80, 90, 100, 150, 200, 500, 1000 or 2000 nucleotides of SEQ ID No. 2 to 17 or 79 to 132, or a complementary sequence thereto, as well as isolated, purified, or recombinant polynucleotides comprising a g35030 nucleotide sequence having at least 70, 75, 80, 85, 90, or 95% nucleotide identity with at least one sequence selected from the group consisting of the following nucleotide positions of SEQ ID No. 2 to 17 or 79 to 132; or a complementary sequence thereto or a fragment thereof. The invention also relates to nucleic acid probes characterized in that they hybridize specifically, under the stringent hybridization conditions defined above, with a contiguous span of at least 12, 15, 18, 20, 25, 30, 35, 40, 50, 60, 70, 80, 90, 100, 150, 200, 500, 1000 or 2000 nucleotides of nucleotide SEQ ID No. 2 to 17 or 79 to 132, or a variant thereof or a sequence complementary thereto.

The formation of stable hybrids depends on the melting temperature (Tm) of the DNA. The Tm depends on the length of the primer or probe, the ionic strength of the solution and the G+C content. The higher the G+C content of the primer or probe, the higher is the melting temperature because G:C pairs are held by three H bonds whereas A:T pairs have only two. The GC content in the probes of the invention usually ranges between 10 and 75%, preferably between 35 and 60%, and more preferably between 40 and 55%.

A probe or a primer according to the invention may be between 8 and 2000 nucleotides in length, or is specified to be at least 12, 15, 18, 20, 25, 35, 40, 50, 60, 70, 80, 100, 250, 500, 1000 nucleotides in length. More particularly, the length of these probes can range from 8, 10, 15, 20, or 30 to 100 nucleotides, preferably from 10 to 50, more preferably from 15 to 30 nucleotides. Shorter probes tend to lack specificity for a target nucleic acid sequence and generally require cooler temperatures to form sufficiently stable hybrid complexes with the template. Longer probes are expensive to produce and can sometimes self-hybridize to form hairpin structures. The appropriate length for primers and probes under a particular set of assay conditions may be empirically determined by one of skill in the art.

The primers and probes can be prepared by any suitable method, including, for example, cloning and restriction of appropriate sequences and direct chemical synthesis by a method such as the phosphodiester method of Narang et al.(1979), the phosphodiester method of Brown et al.(1979), the diethylphosphoramidite method of Beaucage et al.(1981) and the solid support method described in EP 0 707 592.

Detection probes are generally nucleic acid sequences or uncharged nucleic acid analogs such as, for example peptide nucleic acids which are disclosed in International Patent Application WO 92/20702, morpholino analogs which are described in U.S. Pat. Nos. 5,185,444; 5,034,506 and 5,142,047. The probe may have to be rendered "non-extendable" in that additional dNTPs cannot be added to the probe. In and of themselves analogs usually are non-extendable and nucleic acid probes can be rendered non-extendable by modifying the 3' end of the probe such that the hydroxyl group is no longer capable of participating in elongation. For example, the 3' end of the probe can be functionalized with the capture or detection label to thereby consume or otherwise block the hydroxyl group. Alternatively, the 3' hydroxyl group simply can be cleaved, replaced or modified; U.S. patent application Ser. No. 07/049,061 filed Apr. 19, 1993, describes modifications which can be used to render a probe non-extendable.

Any of the polynucleotides of the present invention can be labeled, if desired, by incorporating a label detectable by spectroscopic, photochemical, biochemical, immunochemical, or chemical means. For example, useful labels include radioactive substances ($^{32}P$, $^{35}S$, $^{3}H$, $^{125}I$), fluorescent dyes (5-bromodesoxyuridin, fluorescein, acetylaminofluorene, digoxigenin) or biotin. Preferably, polynucleotides are labeled at their 3' and 5' ends. Examples of non-radioactive labeling of nucleic acid fragments are described in the French patent No. FR-7810975 or by Urdea et al (1988) or Sanchez-Pescador et al (1988). In addition, the probes according to the present invention may have structural characteristics such that they allow the signal amplification, such structural characteristics being, for example, branched DNA probes as those described by Urdea et al. in 1991 or in the European patent No. EP 0 225 807 (Chiron).

A label can also be used to capture the primer, so as to facilitate the immobilization of either the primer or a primer extension product, such as amplified DNA, on a solid support. A capture label is attached to the primers or probes and can be a specific binding member which forms a binding pair with the solid's phase reagent's specific binding member (e.g. biotin and streptavidin). Therefore depending upon the type of label carried by a polynucleotide or a probe, it may be employed to capture or to detect the target DNA. Further, it will be understood that the polynucleotides, primers or probes provided herein, may, themselves, serve as the capture label. For example, in the case where a solid phase reagent's binding member is a nucleic acid sequence, it may be selected such that it binds a complementary portion of a primer or probe to thereby immobilize the primer or probe to the solid phase. In cases where a polynucleotide probe itself serves as the binding member, those skilled in the art will recognize that the probe will contain a sequence or "tail" that is not complementary to the target. In the case where a polynucleotide primer itself serves as the capture label, at least a portion of the primer will be free to hybridize with a nucleic acid on a solid phase. DNA Labeling techniques are well known to the skilled technician.

The probes of the present invention are useful for a number of purposes. They can be notably used in Southern hybridization to genomic DNA. The probes can also be used to detect PCR amplification products. They may also be used to detect mismatches in a sequence comprising a polynucleotide of SEQ ID Nos 1 to 17, 24, 25, 28, 74 and 79 to 132, or a g35030 polynucleotide or gene or mRNA using other techniques.

Any of the polynucleotides, primers and probes of the present invention can be conveniently immobilized on a solid support. Solid supports are known to those skilled in the art and include the walls of wells of a reaction tray, test tubes, polystyrene beads, magnetic beads, nitrocellulose strips, membranes, microparticles such as latex particles, sheep (or other animal) red blood cells, duracytes and others. The solid support is not critical and can be selected by one skilled in the art. Thus, latex particles, microparticles, magnetic or non-magnetic beads, membranes, plastic tubes, walls of microtiter wells, glass or silicon chips, sheep (or other suitable animal's) red blood cells and duracytes are all suitable examples. Suitable methods for immobilizing nucleic acids on solid phases include ionic, hydrophobic, covalent interactions and the like. A solid support, as used herein, refers to any material which is insoluble, or can be made insoluble by a subsequent reaction. The solid support can be chosen for its intrinsic ability to attract and immobilize the capture reagent. Alternatively, the solid phase can retain an additional receptor which has the ability to attract and immobilize the capture reagent. The additional receptor can include a charged substance that is oppositely charged with respect to the capture reagent itself or to a charged substance conjugated to the capture reagent. As yet another alternative, the receptor molecule can be any specific binding member which is immobilized upon (attached to) the solid support and which has the ability to immobilize the capture reagent through a specific binding reaction. The receptor molecule enables the indirect binding of the capture reagent to a solid support material before the performance of the assay or during the performance of the assay. The solid phase thus can be a plastic, derivatized plastic, magnetic or non-magnetic metal, glass or silicon surface of a test tube, microtiter well, sheet, bead, microparticle, chip, sheep (or other suitable animal's) red blood cells, duracytes and other configurations known to those of ordinary skill in the art. The polynucleotides of the invention can be attached to or immobilized on a solid support individually or in groups of at least 2, 5, 8, 10, 12, 15, 20, or 25 distinct polynucleotides of the invention to a single solid support. In addition, polynucleotides other than those of the invention may be attached to the same solid support as one or more polynucleotides of the invention.

Consequently, the invention also comprises a method for detecting the presence of a nucleic acid comprising a nucleotide sequence selected from a group consisting of SEQ ID Nos. 1 to 17, 24, 25, 28, 74 and 79 to 132, a fragment or a variant thereof or a complementary sequence thereto in a sample, said method comprising the following steps of:

a) bringing into contact a nucleic acid probe or a plurality of nucleic acid probes which can hybridize with a nucleotide sequence included in a nucleic acid selected form the group consisting of the nucleotide sequences of SEQ ID Nos. 1 to 17, 24, 25, 28, 74 and 79 to 132, a fragment or a variant thereof or a complementary sequence thereto and the sample to be assayed; and b) detecting the hybrid complex formed between the probe and a nucleic acid in the sample.

The invention further concerns a kit for detecting the presence of a nucleic acid comprising a nucleotide sequence selected from a group consisting of SEQ ID Nos. 1 to 17, 24, 25, 28, 74 and 79 to 132, a fragment or a variant thereof or a complementary sequence thereto in a sample, said kit comprising:

a) a nucleic acid probe or a plurality of nucleic acid probes which can hybridize with a nucleotide sequence included in a nucleic acid selected form the group consisting of the nucleotide sequences of SEQ ID Nos. 1 to 17, 24, 25, 28, 74 and 79 to 132, a fragment or a variant thereof or a complementary sequence thereto; and b) optionally, the reagents necessary for performing the hybridization reaction.

In a first preferred embodiment of this detection method and kit, said nucleic acid probe or the plurality of nucleic acid probes are labeled with a detectable molecule. In a second preferred embodiment of said method and kit, said nucleic acid probe or the plurality of nucleic acid probes has been immobilized on a substrate. In a third preferred embodiment, the nucleic acid probe or the plurality of nucleic acid probes comprise either a sequence which is selected from the group consisting of the nucleotide sequences of P1 to P127 and the complementary sequence thereto, B1 to B114, C1 to C114, D1 to D 27, E1 to E127, or a nucleotide sequence comprising a biallelic marker selected from the group consisting of A1 to A127, or the complements thereto.

Oligonucleotide Arrays

A substrate comprising a plurality of oligonucleotide primers or probes of the invention may be used either for detecting or amplifying targeted sequences in a nucleotide sequence of SEQ ID No. 1, more particularly in a g35030 polynucleotide, or in genes comprising a g35030 polynucleotide and may also be used for detecting mutations in the coding or in the non-coding sequences of a g35030 nucleic acid sequence, or genes comprising a g35030 nucleic acid sequence.

Any polynucleotide provided herein may be attached in overlapping areas or at random locations on the solid support. Alternatively the polynucleotides of the invention may be attached in an ordered array wherein each polynucleotide is attached to a distinct region of the solid support which does not overlap with the attachment site of any other polynucleotide. Preferably, such an ordered array of polynucleotides is designed to be "addressable" where the distinct locations are recorded and can be accessed as part of an assay procedure. Addressable polynucleotide arrays typically comprise a plurality of different oligonucleotide probes that are coupled to a surface of a substrate in different known locations. The knowledge of the precise location of each polynucleotides location makes these "addressable" arrays particularly useful in hybridization assays. Any addressable array technology known in the art can be employed with the polynucleotides of the invention. One particular embodiment of these polynucleotide arrays is known as Genechips™, and has been generally described in U.S. Pat. No. 5,143,854; PCT publications WO 90/15070 and 92/10092. These arrays may generally be produced using mechanical synthesis methods or light directed synthesis methods which incorporate a combination of photolithographic methods and solid phase oligonucleotide synthesis (Fodor et al., 1991, incorporated herein by reference). The immobilization of arrays of oligonucleotides on solid supports has been rendered possible by the development of a technology generally identified as "Very Large Scale Immobilized Polymer Synthesis" (VLSIPS™) in which, typically, probes are immobilized in a high density array on a solid surface of a chip. Examples of VLSIPS™ technologies are provided in U.S. Pat. Nos. 5,143,854; and 5,412,087 and in PCT Publications WO 90/15070, WO 92/10092 and WO 95/11995, which describe methods for forming oligonucleotide arrays through techniques such as light-directed synthesis techniques. In designing strategies aimed at providing arrays of nucleotides immobilized on solid supports, further presentation strategies were developed to order and display the oligonucleotide arrays on the chips in an attempt to maximize hybridization patterns and sequence information. Examples of such presentation strategies are disclosed in PCT Publications WO 94/12305, WO 94/11530, WO 97/29212 and WO 97/31256.

In another embodiment of the oligonucleotide arrays of the invention, an oligonucleotide probe matrix may advantageously be used to detect mutations occurring in a g35030 polynucleotide, including in genes comprising a g35030 polynucleotide and preferably in a g35030 polynucleotide regulatory region. For this particular purpose, probes are specifically designed to have a nucleotide sequence allowing their hybridization to the genes that carry known mutations (either by deletion, insertion or substitution of one or several nucleotides). By known mutations in a g35030 polynucleotide, it is meant, mutations in a g35030 polynucleotide that have been identified according; the technique used by Huang et al.(1996) or Samson et al.(1996), for example, may be used to identify such mutations.

Another technique that is used to detect mutations in a g35030 polynucleotide is the use of a high-density DNA array. Each oligonucleotide probe constituting a unit element of the high density DNA array is designed to match a specific subsequence of a g35030 polynucleotide. Thus, an array consisting of oligonucleotides complementary to subsequences of the target gene sequence is used to determine the identity of the target sequence with the wild-type gene sequence, measure its amount, and detect differences between the target sequence and the reference wild-type nucleic acid sequence of a g35030 polynucleotide. In one such design, termed 4L tiled array, is implemented a set of four probes (A, C, G, T), preferably 15-nucleotide oligomers. In each set of four probes, the perfect complement will hybridize more strongly than mismatched probes. Consequently, a nucleic acid target of length L is scanned for mutations with a tiled array containing 4L probes, the whole probe set containing all the possible mutations in the known wild reference sequence. The hybridization signals of the 15-mer probe set tiled array are perturbed by a single base change in the target sequence. As a consequence, there is a characteristic loss of signal or a "footprint" for the probes flanking a mutation position. This technique was described by Chee et al. in 1996.

Consequently, the invention concerns an array of nucleic acid molecules comprising at least one polynucleotide described above as probes and primers. Preferably, the invention concerns an array of nucleic acid comprising at least two polynucleotides described above as probes and primers.

G35030 Proteins and Polypeptide Fragments

The terms "g35030 polypeptides", are used herein to embrace all of the proteins and polypeptides encoded by the respective g35030 polypeptides of the present invention. Forming part of the invention are polypeptides encoded by the polynucleotides of the invention, as well as fusion polypeptides comprising such polypeptides. The invention embodies proteins from humans, mammals, primates, non-human primates, and includes isolated or purified g35030 proteins consisting, consisting essentially, or comprising the sequence of SEQ ID Nos 18 to 23.

It should be noted that the g35030 proteins of the invention also comprise naturally-occurring variants of the amino acid sequence of the respective human g35030 proteins.

The present invention embodies isolated, purified, and recombinant polypeptides comprising a contiguous span of at least 4 amino acids, preferably at least 6, more preferably at least 8 to 10 amino acids, more preferably at least 12, 15, 20, 25, 30, 40, 50, 60, 70, 80, 90, 95 or 100 amino acids, to the extent that said span is consistent with the length of a particular SEQ ID, of SEQ ID Nos 18 to 23. In other preferred embodiments the contiguous stretch of amino acids comprises the site of a mutation or functional mutation, including a deletion, addition, swap or truncation of the amino acids in a g35030 protein sequence. In one aspect, the contiguous stretch of amino acids comprises deletion, addition, swap or truncation at amino acid position 13 of SEQ ID Nos 18 to 23, corresponding to polymorphism described herein by biallelic markers 8-126-286 (also referred to as 8-130-143) and 8-155-258.

The invention further embodies g35030 polypeptides, including isolated and recombinant polypeptides, encoded respectively by g35030 polynucleotides consisting, consisting essentially, or comprising a contiguous span of at least 12, 15, 18, 20, 25, 30, 35, 40, 50, 60, 70, 80, 90, 100, 150, 200 or 500 nucleotides of SEQ ID Nos 2 to 17.

The invention further embodies g35030 polypeptides, including isolated and recombinant polypeptides, encoded respectively by g35030 polynucleotides consisting, consisting essentially, or comprising a contiguous span of at least 12, 15, 18, 20, 25, 30, 35, 40, 50, 60, 70, 80, 90, 100, 150, 200 or 500 nucleotides, to the extent that the length of said span is consistent with the nucleotide position range, of SEQ ID No 1, wherein said contiguous span comprises at least 1, 2, 3, 4, 5, 7 or 10 of the following nucleotide positions of SEQ ID No 1: 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561 and 246273 to 247802, or the complements thereof.

g35030 proteins are preferably isolated from human or mammalian tissue samples or expressed from human or mammalian genes. The g35030 polypeptides of the invention can be made using routine expression methods known in the art. The polynucleotide encoding the desired polypeptide, is ligated into an expression vector suitable for any convenient host. Both eukaryotic and prokaryotic host systems is used in forming recombinant polypeptides, and a summary of some of the more common systems. The polypeptide is then isolated from lysed cells or from the culture medium and purified to the extent needed for its intended use. Purification is by any technique known in the art, for example, differential extraction, salt fractionation, chromatography, centrifugation, and the like. See, for example, Methods in Enzymology for a variety of methods for purifying proteins.

In addition, shorter protein fragments can be produced by chemical synthesis. Alternatively the proteins of the invention is extracted from cells or tissues of humans or non-human animals. Methods for purifying proteins are known in the art, and include the use of detergents or chaotropic agents to disrupt particles followed by differential extraction and separation of the polypeptides by ion exchange chromatography, affinity chromatography, sedimentation according to density, and gel electrophoresis.

Any g35030 cDNA or fragment thereof, including the respective cDNA sequences of SEQ ID Nos 2 to 17, is used to express g35030 proteins and polypeptides. The nucleic acid encoding the g35030 protein or polypeptide to be expressed is operably linked to a promoter in an expression vector using conventional cloning technology. The g35030 insert in the expression vector may comprise the full coding sequence for the respective g35030 protein or a portion thereof. For example, the g35030 derived insert may encode a polypeptide comprising at least 10 consecutive amino acids of the respective g35030 protein of SEQ ID Nos 18 to 23.

The expression vector is any of the mammalian, yeast, insect or bacterial expression systems known in the art. Commercially available vectors and expression systems are available from a variety of suppliers including Genetics Institute (Cambridge, Mass.), Stratagene (La Jolla, Calif.), Promega (Madison, Wis.), and Invitrogen (San Diego, Calif.). If desired, to enhance expression and facilitate proper protein folding, the codon context and codon pairing of the sequence is optimized for the particular expression organism in which the expression vector is introduced, as explained by Hatfield, et al., U.S. Pat. No. 5,082,767.

In one embodiment, the entire coding sequence of the g35030 cDNA through the poly A signal of the cDNA are operably linked to a promoter in the expression vector. Alternatively, if the nucleic acid encoding a portion of the g35030 protein lacks a methionine to serve as the initiation site, an initiating methionine can be introduced next to the first codon of the nucleic acid using conventional tech-niques. Similarly, if the insert from the g35030 cDNA lacks a poly A signal, this sequence can be added to the construct by, for example, splicing out the Poly A signal from pSG5 (Stratagene) using BglII and SalI restriction endonuclease enzymes and incorporating it into the mammalian expression vector pXT1 (Stratagene). pXT1 contains the LTRs and a portion of the gag gene from Moloney Murine Leukemia Virus. The position of the LTRs in the construct allow efficient stable transfection. The vector includes the Herpes Simplex Thymidine Kinase promoter and the selectable neomycin gene. The nucleic acid encoding the g35030 protein or a portion thereof is obtained by PCR from a bacterial vector containing the a nucleotide sequence of an exon of a g35030 gene as described herein and in SEQ ID No 1, or from a g35030 cDNA comprising a nucleic acid of SEQ ID No 2 to 17 using oligonucleotide primers complementary to the g35030 nucleic acid or portion thereof and containing restriction endonuclease sequences for Pst I incorporated into the 5' primer and BglII at the 5' end of the corresponding cDNA 3' primer, taking care to ensure that the sequence encoding the g35030 protein or a portion thereof is positioned properly with respect to the poly A signal. The purified fragment obtained from the resulting PCR reaction is digested with PstI, blunt ended with an exonuclease, digested with Bgl II, purified and ligated to pXT1, now containing a poly A signal and digested with BglII.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 ug/ml G418 (Sigma, St. Louis, Mo.).

Alternatively, the nucleic acids encoding the g35030 protein or a portion thereof is cloned into pED6dpc2 (Genetics Institute, Cambridge, Mass.). The resulting pED6dpc2 constructs is transfected into a suitable host cell, such as COS 1 cells. Methotrexate resistant cells are selected and expanded.

The above procedures may also be used to express a mutant g35030 protein responsible for a detectable phenotype or a portion thereof.

The expressed proteins are purified using conventional purification techniques such as ammonium sulfate precipitation or chromatographic separation based on size or charge. The protein encoded by the nucleic acid insert may also be purified using standard immunochromatography techniques. In such procedures, a solution containing the expressed g35030 protein or portion thereof, such as a cell extract, is applied to a column having antibodies against the g35030 protein or portion thereof is attached to the chromatography matrix. The expressed protein is allowed to bind the immunochromatography column. Thereafter, the column is washed to remove non-specifically bound proteins. The specifically bound expressed protein is then released from the column and recovered using standard techniques.

To confirm expression of the g35030 protein or a portion thereof, the proteins expressed from host cells containing an expression vector containing an insert encoding the g35030 protein or a portion thereof can be compared to the proteins expressed in host cells containing the expression vector without an insert. The presence of a band in samples from cells containing the expression vector with an insert which is absent in samples from cells containing the expression vector without an insert indicates that the g35030 protein or a portion thereof is being expressed. Generally, the band will have the mobility expected for the g35030 protein or portion thereof. However, the band may have a mobility different than that expected as a result of modifications such as glycosylation, ubiquitination, or enzymatic cleavage.

Antibodies capable of specifically recognizing the expressed g35030 protein or a portion thereof are described below.

If antibody production is not possible, the nucleic acids encoding the g35030 protein or a portion thereof is incorporated into expression vectors designed for use in purification schemes employing chimeric polypeptides. In such strategies the nucleic acid encoding the g35030 protein or a portion thereof is inserted in frame with the gene encoding the other half of the chimera. The other half of the chimera is β-globin or a nickel binding polypeptide encoding sequence. A chromatography matrix having antibody to β-globin or nickel attached thereto is then used to purify the chimeric protein. Protease cleavage sites is engineered between the β-globin gene or the nickel binding polypeptide and the g35030 protein or portion thereof. Thus, the two polypeptides of the chimera is separated from one another by protease digestion.

One useful expression vector for generating β-globin chimeric proteins is pSG5 (Stratagene), which encodes rabbit β-globin. Intron II of the rabbit β-globin gene facilitates splicing of the expressed transcript, and the polyadenylation signal incorporated into the construct increases the level of expression. These techniques are well known to those skilled in the art of molecular biology. Standard methods are published in methods texts such as Davis et al., (1986) and many of the methods are available from Stratagene, Life Technologies, Inc., or Promega. Polypeptide may additionally be produced from the construct using in vitro translation systems such as the In vitro Express™ Translation Kit (Stratagene).

Antibodies that Bind g35030 Polypeptides of the Invention

Any g35030 polypeptide or whole protein may be used to generate antibodies capable of specifically binding to an expressed g35030 protein or fragments thereof.

For an antibody composition to specifically bind to a g35030 protein, it must demonstrate at least a 5%, 10%, 15%, 20%, 25%, 50%, or 100% greater binding affinity for full length g35030 protein than for any full length protein in an ELISA, RIA, or other antibody-based binding assay. For an antibody composition to specifically bind to a variant g35030 protein, it must demonstrate at least a 5%, 10%, 15%, 20%, 25%, 50%, or 100% greater binding affinity for the respective full length variant g35030 protein than for the respective reference g35030 full length protein in an ELISA, RIA, or other antibody-based binding assay.

One antibody composition of the invention is capable of specifically binding or specifically binds to the respective g35030 proteins of SEQ ID Nos 18 to 23. Other antibody compositions of the invention are capable of specifically binding or specifically bind to a g35030 protein variant.

In one embodiment, the invention concerns antibody compositions, either polyclonal or monoclonal, capable of selectively binding, or selectively bind to an epitope-containing a polypeptide comprising a contiguous span of at least 6 amino acids, preferably at least 8 to 10 amino acids, more preferably at least 12, 15, 20, 25, 30, 40, 50, or 100 amino acids of a g35030 polypeptide.

The invention also concerns a purified or isolated antibody capable of specifically binding to a mutated g35030 protein or to a fragment or variant thereof comprising an epitope of the mutated g35030 protein. In another preferred embodiment, the present invention concerns an antibody capable of binding to a polypeptide comprising at least 10 consecutive amino acids of a g35030 protein and including at least one of the amino acids which can be encoded by the trait causing mutations.

An epitope can comprise as few as 3 amino acids in a spatial conformation, which is unique to the epitope. Generally an epitope consists of at least 6 such amino acids, and more often at least 8–10 such amino acids. In preferred embodiment, antigenic epitopes comprise a number of amino acids that is any integer between 3 and 50. Fragments which function as epitopes may be produced by any conventional means. Epitopes can be determined by a Jameson-Wolf antigenic analysis, for example, performed using the computer program PROTEAN, using default parameters (Version 4.0 Windows, DNASTAR, Inc., 1228 South Park Street Madison, Wis.

Predicted antigenic epitopes are shown below. It is pointed out that the immunogenic epitope list describe only amino acid residues comprising epitopes predicted to have the highest degree of immunogenicity by a particular algorithm. Polypeptides of the present invention that are not specifically described as immunogenic are not considered non-antigenic. This is because they may still be antigenic in vivo but merely not recognized as such by the particular algorithm used. Alternatively, the polypeptides are probably antigenic in vitro using methods such a phage display. Thus, listed below are the amino acid residues comprising only preferred epitopes, not a complete list. In fact, all fragments of the polypeptides of the present invention, at least 6 amino acids residues in length, are included in the present invention as being useful as antigenic epitope. Moreover, listed below are only the critical residues of the epitopes determined by the Jameson-Wolf analysis. Thus, additional flanking residues on either the N-terminal, C-terminal, or both N- and C-terminal ends may be added to the sequences listed to generate an epitope-bearing portion at least 6 residues in length. Amino acid residues comprising other immunogenic epitopes may be determined by algorithms similar to the Jameson-Wolf analysis or by in vivo testing for an antigenic response using the methods described herein or those known in the art.

The epitope-bearing fragments of the present invention preferably comprises 6 to 50 amino acids (i.e. any integer between 6 and 50, inclusive) of a polypeptide of the present invention. Also, included in the present invention are antigenic fragments between the integers of 6 and the full length g35030 sequence.

Preferred g35030 Immunogenic Epitopes

SEQ ID No. 18: Val-9 to Arg-11; Gly-21 to Lys-22

SEQ ID No. 19: Val-9 to Arg-11; Pro-45 to Pro-52

SEQ ID No. 20: Val-9 to Arg-11

SEQ ID No. 21: Val-9 to Arg-11; Ser-40 to Ser-42

SEQ ID No. 22: Val-9 to Arg-11

SEQ ID No. 23: Val-9 to Arg-11; Pro-45 to Glu-49; Ser-57 to Val-60

Non-human animals or mammals, whether wild-type or transgenic, which express a different species of g35030 than the one to which antibody binding is desired, and animals which do not express g35030 (i.e. a g35030 knock out animal as described herein) are particularly useful for preparing antibodies. g35030 knock out animals will recognize all or most of the exposed regions of a g35030 protein as foreign antigens, and therefore produce antibodies with a wider array of g35030 epitopes. Moreover, smaller polypeptides with only 10 to 30 amino acids may be useful in obtaining specific binding to any one of the g35030 proteins. In addition, the humoral immune system of animals which produce a species of g35030 that resembles the antigenic sequence will preferentially recognize the differences between the animal's native g35030 species and the antigen sequence, and produce antibodies to these unique sites in the antigen sequence. Such a technique will be particularly useful in obtaining antibodies that specifically bind to any one of the g35030 proteins.

Antibody preparations prepared according to either protocol are useful in quantitative immunoassays which determine concentrations of antigen-bearing substances in biological samples; they are also used semi-quantitatively or qualitatively to identify the presence of antigen in a biological sample. The antibodies may also be used in therapeutic compositions for killing cells expressing the protein or reducing the levels of the protein in the body.

The antibodies of the invention may be labeled by any one of the radioactive, fluorescent or enzymatic labels known in the art.

Consequently, the invention is also directed to a method for detecting specifically the presence of a g35030 polypeptide according to the invention in a biological sample, said method comprising the following steps:

a) bringing into contact the biological sample with a polyclonal or monoclonal antibody that specifically binds a g35030 polypeptide comprising an amino acid sequence of SEQ ID Nos. 18 to 23, or to a peptide fragment or variant thereof; and b) detecting the antigen-antibody complex formed.

The invention also concerns a diagnostic kit for detecting in vitro the presence of a g35030 polypeptide according to the present invention in a biological sample, wherein said kit comprises:

a) a polyclonal or monoclonal antibody that specifically binds a g35030 polypeptide comprising an amino acid sequence of SEQ ID Nos 18 to 23, or to a peptide fragment or variant thereof, optionally labeled;

b) a reagent allowing the detection of the antigen-antibody complexes formed, said reagent carrying optionally a label, or being able to be recognized itself by a labeled reagent, more particularly in the case when the above-mentioned monoclonal or polyclonal antibody is not labeled by itself.

The present invention thus relates to antibodies and T-cell antigen receptors (TCR), which specifically bind the polypeptides, and more specifically, the epitopes of the polyepeptides of the present invention, including but not limited to IgG (including IgG1, IgG2, IgG3, and IgG4), IgA (including IgA1 and IgA2), IgD, IgE, or IgM, and IgY. In a preferred embodiment the antibodies are human antigen binding antibody fragments of the present invention include, but are not limited to, Fab, Fab' F(ab)2 and F(ab')2, Fd, single-chain Fvs (scFv), single-chain antibodies, disulfide-linked Fvs (sdFv) and fragments comprising either a $V_L$ or $V_H$ domain. The antibodies may be from any animal origin including birds and mammals. Preferably, the antibodies are human, murine, rabbit, goat, guinea pig, camel, horse, or chicken.

Antigen-binding antibody fragments, including single-chain antibodies, may comprise the variable region(s) alone or in combination with the entire or partial of the following: hinge region, CH1, CH2, and CH3 domains. Also included in the invention are any combinations of variable region(s) and hinge region, CH1, CH2, and CH3 domains. The present invention further includes chimeric, humanized, and human monoclonal and polyclonal antibodies, which specifically bind the polypeptides of the present invention. The present invention further includes antibodies that are anti-idiotypic to the antibodies of the present invention.

The antibodies of the present invention may be monospecific, bispecific, trispecific or have greater multispecificity. Multispecific antibodies may be specific for different epitopes of a polypeptide of the present invention or may be specific for both a polypeptide of the present invention as well as for heterologous compositions, such as a heterologous polypeptide or solid support material. See, e.g., WO 93/17715; WO 92/08802; WO 91/00360; WO 92/05793; Tutt, A. et al. (1991) J. Immunol. 147:60–69; U.S. Pat. Nos. 5,573,920, 4,474,893, 5,601,819, 4,714,681, 4,925,648; Kostelny, S. A. et al. (1992) J. Immnunol. 148:1547–1553.

Antibodies of the present invention may be described or specified in terms of the epitope(s) or epitope-bearing portion(s) of a polypeptide of the present invention, which are recognized or specifically bound by the antibody. In the case of proteins of the present invention secreted proteins, the antibodies may specifically bind a full-length protein encoded by a nucleic acid of the present invention, a mature protein (i.e., the protein generated by cleavage of the signal peptide) encoded by a nucleic acid of the present invention, a signal peptide encoded by a nucleic acid of the present invention, or any other polypeptide of the present invention. Therefore, the epitope(s) or epitope bearing polypeptide portion(s) may be specified as described herein, e.g., by N-terminal and C-terminal positions, by size in contiguous amino acid residues, or otherwise described herein (including the squence listing). Antibodies which specifically bind any epitope or polypeptide of the present invention may also be excluded as individual species. Therefore, the present invention includes antibodies that specifically bind specified polypeptides of the present invention, and allows for the exclusion of the same.

Antibodies of the present invention may also be described or specified in terms of their cross-reactivity. Antibodies that do not specifically bind any other analog, ortholog, or homolog of the polypeptides of the present invention are included. Antibodies that do not bind polypeptides with less than 95%, less than 90%, less than 85%, less than 80%, less than 75%, less than 70%, less than 65%, less than 60%, less than 55%, and less than 50% identity (as calculated using methods known in the art and described herein) to a polypeptide of the present invention are also included in the present invention. Further included in the present invention are antibodies, which only bind polypeptides encoded by polynucleotides, which hybridize to a polynucleotide of the present invention under stringent hybridization conditions (as described herein). Antibodies of the present invention may also be described or specified in terms of their binding affinity. Preferred binding affinities include those with a dissociation constant or Kd less than $5 \times 10^{-6}$M, $10^{-6}$M, $5 \times 10^{-7}$M, $5 \times 10^{-8}$M, $10^{-8}$M, $5 \times 10^{-9}$M, $10^{-9}$M, $5 \times 10^{-10}$M, $10^{-10}$M, $5 \times 10^{-11}$M, $10^{-11}$M, $5 \times 10^{-12}$M, $10^{-12}$M, $5 \times 10^{-13}$M, $10^{-13}$M, $5 \times 10^{-14}$M, $10^{-14}$M, $5 \times 10^{-15}$M, and $10^{-15}$M.

Antibodies of the present invention have uses that include, but are not limited to, methods known in the art to purify, detect, and target the polypeptides of the present invention including both in vitro and in vivo diagnostic and therapeutic methods. For example, the antibodies have use in immunoassays for qualitatively and quantitatively measuring levels of the polypeptides of the present invention in biological samples. See, e.g., Harlow et al., ANTIBODIES: A LABORATORY MANUAL, (Cold Spring Harbor Laboratory Press, 2nd ed. 1988) (incorporated by reference in the entirety).

The antibodies of the present invention may be used either alone or in combination with other compositions. The antibodies may further be recombinantly fused to a heterologous polypeptide at the N- or C-terminus or chemically conjugated (including covalent and non-covalent conjugations) to polypeptides or other compositions. For example, antibodies of the present invention may be recombinantly fused or conjugated to molecules useful as labels in detection assays and effector molecules such as heterologous polypeptides, drugs, or toxins. See, e.g., WO 92/08495; WO 91/14438; WO 89/12624; U.S. Pat. No. 5,314,995; and EP 0 396 387.

The antibodies of the present invention may be prepared by any suitable method known in the art. For example, a polypeptide of the present invention or an antigenic fragment thereof can be administered to an animal in order to induce the production of sera containing polyclonal antibodies. The term "monoclonal antibody" is not limited to antibodies produced through hybridoma technology. The term "antibody" refers to a polypeptide or group of polypeptides which are comprised of at least one binding domain, where a binding domain is formed from the folding of variable domains of an antibody molecule to form three-dimensional binding spaces with an internal surface shape and charge distribution complementary to the features of an antigenic determinant of an antigen, which allows an immunological reaction with the antigen. The term "monoclonal antibody" refers to an antibody that is derived from a single clone, including eukaryotic, prokaryotic, or phage clone, and not the method by which it is produced. Monoclonal antibodies can be prepared using a wide variety of techniques known in the art including the use of hybridoma, recombinant, and phage display technology.

Hybridoma techniques include those known in the art (See, e.g., Harlow et al. (1998); Hammerling, et al. (1981) (said references incorporated by reference in their entireties). Fab and F(ab')2 fragments may be produced, for example, from hybridoma-produced antibodies by proteolytic cleavage, using enzymes such as papain (to produce Fab fragments) or pepsin (to produce F(ab')2 fragments).

Alternatively, antibodies of the present invention can be produced through the application of recombinant DNA technology or through synthetic chemistry using methods known in the art. For example, the antibodies of the present invention can be prepared using various phage display methods known in the art. In phage display methods, functional antibody domains are displayed on the surface of a phage particle, which carries polynucleotide sequences encoding them. Phage with a desired binding property are selected from a repertoire or combinatorial antibody library (e.g. human or murine) by selecting directly with antigen, typically antigen bound or captured to a solid surface or bead. Phage used in these methods are typically filamentous phage including fd and M13 with Fab, Fv or disulfide stabilized Fv antibody domains recombinantly fused to either the phage gene III or gene VIII protein. Examples of phage display methods that can be used to make the antibodies of the present invention include those disclosed in Brinkman U. et al. (1995); Ames, R. S. et al. (1995); Kettleborough, C. A. et al. (1994); Persic, L. et al. (1997); Burton, D. R. et al. (1994); PCT/GB91/01134; WO 90/02809; WO 91/10737; WO 92/01047; WO 92/18619; WO 93/11236; WO 95/15982; WO 95/20401; and U.S. Pat. Nos. 5,698,426, 5,223,409, 5,403,484, 5,580,717, 5,427,908, 5,750,753, 5,821,047, 5,571,698, 5,427,908, 5,516,637, 5,780,225, 5,658,727 and 5,733,743 (said references incorporated by reference in their entireties).

As described in the above references, after phage selection, the antibody coding regions from the phage can be isolated and used to generate whole antibodies, including human antibodies, or any other desired antigen binding fragment, and expressed in any desired host including mammalian cells, insect cells, plant cells, yeast, and bacteria. For example, techniques to recombinantly produce Fab, Fab' F(ab)2 and F(ab')2 fragments can also be employed using methods known in the art such as those disclosed in WO 92/22324; Mullinax, R. L. et al. (1992); and Sawai, H. et al. (1995); and Better, M. et al. (1988) (said references incorporated by reference in their entireties).

Examples of techniques which can be used to produce single-chain Fvs and antibodies include those described in U.S. Pat. Nos. 4,946,778 and 5,258,498; Huston et al. (1991); Shu, L. et al. (1993); and Skerra, A. et al. (1988). For some uses, including in vivo use of antibodies in humans and in vitro detection assays, it may be preferable to use chimeric, humanized, or human antibodies. Methods for producing chimeric antibodies are known in the art. See e.g., Morrison (1985); Oi et al., (1986); Gillies, S. D. et al. (1989); and U.S. Pat. No. 5,807,715. Antibodies can be humanized using a variety of techniques including CDR-grafting (EP 0 239 400; WO 91/09967; U.S. Pat. No. 5,530,101; and 5,585,089), veneering or resurfacing (EP 0 592 106; EP 0 519 596; Padlan E. A., (1991); Studnicka G. M. et al. (1994); Roguska M. A. et al. (1994), and chain shuffling (U.S. Pat. No. 5,565,332). Human antibodies can be made by a variety of methods known in the art including phage display methods described above. See also, U.S. Pat. Nos. 4,444,887, 4,716,111, 5,545,806, and 5,814,318; WO 98/46645; WO 98/50433; WO 98/24893; WO 96/34096; WO 96/33735; and WO 91/10741 (said references incorporated by reference in their entireties).

Further included in the present invention are antibodies recombinantly fused or chemically conjugated (including both covalently and non-covalently conjugations) to a polypeptide of the present invention. The antibodies may be specific for antigens other than polypeptides of the present invention. For example, antibodies may be used to target the polypeptides of the present invention to particular cell types, either in vitro or in vivo, by fusing or conjugating the polypeptides of the present invention to antibodies specific for particular cell surface receptors. Antibodies fused or conjugated to the polypeptides of the present invention may also be used in in vitro immunoassays and purification methods using methods known in the art. See e.g., Harbor et al. supra and WO 93/21232; EP 0 439 095; Naramura, M. et al. (1994); U.S. Pat. No. 5,474,981; Gillies, S. O. et al. (1992); Fell, H. P. et al. (1991) (said references incorporated by reference in their entireties).

The present invention further includes compositions comprising the polypeptides of the present invention fused or conjugated to antibody domains other than the variable regions. For example, the polypeptides of the present invention may be fused or conjugated to an antibody Fc region, or portion thereof. The antibody portion fused to a polypeptide of the present invention may comprise the hinge region, CH1 domain, CH2 domain, and CH3 domain or any combination of whole domains or portions thereof. The polypeptides of the present invention may be fused or conjugated to the above antibody portions to increase the in vivo half-life of the polypeptides or for use in immunoassays using methods known in the art. The polypeptides may also be fused or conjugated to the above antibody portions to form multimers. For example, Fc portions fused to the polypeptides of the present invention can form dimers through disulfide bonding between the Fc portions. Higher multimeric forms can be made by fusing the polypeptides to portions of IgA and IgM. Methods for fusing or conjugating the polypeptides of the present invention to antibody portions are known in the art. See e.g., U.S. Pat. Nos. 5,336,603, 5,622,929, 5,359,046, 5,349,053, 5,447,851, 5,112,946; EP 0 307 434, EP 0 367 166; WO 96/04388, WO 91/06570; Ashkenazi, A. et al. (1991); Zheng, X. X. et al. (1995); and Vil, H. et al. (1992) (said references incorporated by reference in their entireties).

The invention further relates to antibodies that act as agonists or antagonists of the polypeptides of the present invention. For example, the present invention includes antibodies that disrupt the receptor/ligand interactions with the polypeptides of the invention either partially or fully. Included are both receptor-specific antibodies and ligand-specific antibodies. Included are receptor-specific antibodies, which do not prevent ligand binding but prevent receptor activation. Receptor activation (i.e., signaling) may be determined by techniques described herein or otherwise known in the art. Also include are receptor-specific antibodies which both prevent ligand binding and receptor activation. Likewise, included are neutralizing antibodies that bind the ligand and prevent binding of the ligand to the receptor, as well as antibodies that bind the ligand, thereby preventing receptor activation, but do not prevent the ligand from binding the receptor. Further included are antibodies that activate the receptor. These antibodies may act as agonists for either all or less than all of the biological activities affected by ligand-mediated receptor activation. The antibodies may be specified as agonists or antagonists for biological activities comprising specific activities disclosed herein. The above antibody agonists can be made using methods known in the art. See e.g., WO 96/40281; U.S. Pat. No. 5,811,097; Deng, B. et al. (1998); Chen, Z. et al. (1998); Harrop, J. A. et al. (1998); Zhu, Z. et al. (1998); Yoon, D. Y. et al. (1998); Prat, M. et al. (1998); Pitard, V. et al. (1997); Liautard, J. et al. (1997); Carlson, N. G. et al. (1997); Taryman, R. E. et al. (1995); Muller, Y. A. et al. (1998); Bartunek, P. et al. (1996) (said references incorporated by reference in their entireties).

As discussed above, antibodies of the polypeptides of the invention can, in turn, be utilized to generate anti-idiotypic antibodies that "mimic" polypeptides of the invention using techniques well known to those skilled in the art. See, e.g. Greenspan and Bona, (1989); Nissinoff, (1991). For example, antibodies which bind to and competitively inhibit polypeptide multimerization or binding of a polypeptide of the invention to ligand can be used to generate anti-idiotypes that "mimic" the polypeptide multimerization or binding domain and, as a consequence, bind to and neutralize polypeptide or its ligand. Such neutralization anti-idiotypic antibodies can be used to bind a polypeptide of the invention or to bind its ligands/receptors, and therby block its biological activity.

Biallelic Markers of the Inventions

Advantages of the Biallelic Markers of the Present Invention

The biallelic marker of the inventions of the present invention offer a number of important advantages over other genetic markers such as RFLP (Restriction fragment length polymorphism) and VNTR (Variable Number of Tandem Repeats) markers.

The first generation of markers, were RFLPs, which are variations that modify the length of a restriction fragment. But methods used to identify and to type RFLPs are relatively wasteful of materials, effort, and time. The second generation of genetic markers were VNTRs, which can be categorized as either minisatellites or microsatellites. Minisatellites are tandemly repeated DNA sequences present in units of 5–50 repeats which are distributed along regions of the human chromosomes ranging from 0.1 to 20 kilobases in length. Since they present many possible alleles, their informative content is very high. Minisatellites are scored by performing Southern blots to identify the number of tandem repeats present in a nucleic acid sample from the individual being tested. However, there are only $10^4$ potential VNTRs that can be typed by Southern blotting. Moreover, both RFLP and VNTR markers are costly and time-consuming to develop and assay in large numbers.

Single nucleotide polymorphism or biallelic markers can be used in the same manner as RFLPs and VNTRs but offer several advantages. Single nucleotide polymorphisms are densely spaced in the human genome and represent the most frequent type of variation. An estimated number of more than $10^7$ sites are scattered along the $3-10^9$ base pairs of the human genome. Therefore, single nucleotide polymorphism occur at a greater frequency and with greater uniformity than RFLP or VNTR markers which means that there is a greater probability that such a marker will be found in close proximity to a genetic locus of interest. Single nucleotide polymorphisms are less variable than VNTR markers but are mutationally more stable.

Also, the different forms of a characterized single nucleotide polymorphism, such as the biallelic markers of the present invention, are often easier to distinguish and can therefore be typed easily on a routine basis. Biallelic markers have single nucleotide based alleles and they have only two common alleles, which allows highly parallel detection and automated scoring.

The biallelic markers of the present invention offer the possibility of rapid, high-throughput genotyping of a large number of individuals.

Biallelic markers are densely spaced in the genome, sufficiently informative and can be assayed in large numbers. The combined effects of these advantages make biallelic markers extremely valuable in genetic studies. Biallelic markers can be used in linkage studies in families, in allele sharing methods, in linkage disequilibrium studies in populations, in association studies of case-control populations. An important aspect of the present invention is that biallelic markers allow association studies to be performed to identify genes involved in complex traits. Association studies examine the frequency of marker alleles in unrelated case- and control-populations and are generally employed in the detection of polygenic or sporadic traits. Association studies may be conducted within the general population and are not limited to studies performed on related individuals in affected families (linkage studies). Biallelic markers in different genes can be screened in parallel for direct association with disease or response to a treatment. This multiple gene approach is a powerful tool for a variety of human genetic studies as it provides the necessary statistical power to examine the synergistic effect of multiple genetic factors on a particular phenotype, drug response, sporadic trait, or disease state with a complex genetic etiology.

Biallelic Markers and Polynucleotides Comprising Them Polynucleotides of the Present Invention In one aspect, the invention concerns biallelic markers associated with schizophrenia. The invention comprises chromosome 13q31–q33-related biallelic markers and g35030-related biallelic markers. The markers are generally referred to herein as A1, A2, A3 and so on. The biallelic markers of the invention comprise the biallelic markers designated A1 to A127 in Table 5. Also included are biallelic markers in linkage disequilibrium with the biallelic markers of the invention.

The polynucleotide of the invention may consist of, consist essentially of, or comprise a contiguous span of nucleotides of a sequence from any of SEQ ID Nos. 1 to 17, 24, 25, 28, 74 and 79 to 132 as well as sequences which are complementary thereto ("complements thereof"). The "contiguous span" may be at least 8, 10, 12, 15, 18, 20, 25, 35, 40, 50, 70, 80, 100, 250, 500, 1000 or 2000 nucleotides in length, to the extent that a contiguous span of these lengths is consistent with the lengths of the particular Sequence ID.

The present invention encompasses polynucleotides for use as primers and probes in the methods of the invention. These polynucleotides may consist of, consist essentially of, or comprise a contiguous span of nucleotides of a sequence from any of SEQ ID Nos. 1 to 17, 24, 25, 28, 74 and 79 to 132 as well as sequences which are complementary thereto ("complements thereof"). The "contiguous span" may be at least 8, 10, 12, 15, 18, 20, 25, 35, 40, 50, 70, 80, 100, 250, 500, 1000 or 2000 nucleotides in length, to the extent that a contiguous span of these lengths is consistent with the lengths of the particular Sequence ID. It should be noted that the polynucleotides of the present invention are not limited to having the exact flanking sequences surrounding the polymorphic bases which, are enumerated in the Sequence Listing. Rather, it will be appreciated that the flanking sequences surrounding the biallelic markers and other polymorphisms of the invention, or any of the primers of probes of the invention which, are more distant from the markers, may be lengthened or shortened to any extent compatible with their intended use and the present invention specifically contemplates such sequences. It will be appreciated that the polynucleotides of SEQ ID Nos. 1 to 17, 24, 25, 28, 74 and 79 to 132 may be of any length compatible with their intended use. Also the flanking regions outside of the contiguous span need not be homologous to native flanking sequences which actually occur in human subjects. The addition of any nucleotide sequence, which is compatible with the nucleotides intended use is specifically contemplated. The contiguous span may optionally include the biallelic markers of the invention in said sequence. Biallelic markers generally comprise a polymorphism at one single base position. Each biallelic marker therefore corresponds to two forms of a polynucleotide sequence which, when compared with one another, present a nucleotide modification at one position. Usually, the nucleotide modification involves the substitution of one nucleotide for another. Optionally allele 1 or allele 2 of the biallelic markers disclosed in Table 5 may be specified as being present at the biallelic marker of the invention. Preferred polynucleotides may consist of, consist essentially of, or comprise a contiguous span of nucleotides of a sequence from SEQ ID Nos. 1 to 17, 24, 25, 28, 74 and 79 to 132 as well as sequences which are complementary thereto. The "contiguous span" may be at least 8, 10, 12, 15, 18, 20, 25, 35, 40, 50, 70, 80, 100, 250, 500, 1000 or 2000 nucleotides in length, to the extent that a contiguous span of these lengths is consistent with the lengths of the particular Sequence ID.

A preferred probe or primer comprises a nucleic acid comprising a polynucleotide selected from the group of the nucleotide sequences of P1 to P 127 and the complementary sequence thereto, B1 to B114, C1 to C114, D1 to D127, E1 to E127.

The invention also relates to polynucleotides that hybridize, under conditions of high or intermediate stringency, to a polynucleotide of any of SEQ ID Nos. 1 to 17, 24, 25, 28, 74 and 79 to 132 as well as sequences, which are complementary thereto. Preferably such polynucleotides are at least 20, 25, 35, 40, 50, 70, 80, 100, 250, 500, 1000 or 2000 nucleotides in length, to the extent that a polynucleotide of these lengths is consistent with the lengths of the particular Sequence ID. Preferred polynucleotides comprise a polymorphism of the invention. Optionally either allele 1 or allele 2 of the polymorphism disclosed in Table 5 may be specified as being present at the polymorphism of the invention. Particularly preferred polynucleotides comprise a biallelic marker of the invention. Conditions of high stringency are further described herein.

The primers of the present invention may be designed from the disclosed sequences for any method known in the art. A preferred set of primers is fashioned such that the 3' end of the contiguous span of identity with the sequences of any of SEQ ID Nos. 1 to 17, 24, 25, 28, 74 and 79 to 132 is present at the 3' end of the primer. Such a configuration allows the 3' end of the primer to hybridize to a selected nucleic acid sequence and dramatically increases the efficiency of the primer for amplification or sequencing reactions. In a preferred set of primers the contiguous span is found in one of the sequences described in Table 4. Allele specific primers may be designed such that a biallelic marker or other polymorphism of the invention is at the 3' end of the contiguous span and the contiguous span is present at the 3' end of the primer. Such allele specific primers tend to selectively prime an amplification or sequencing reaction so long as they are used with a nucleic acid sample that contains one of the two alleles present at said marker. The 3' end of primer of the invention may be located within or at least 2, 4, 6, 8, 10, 12, 15, 18, 20, 25, 50, 100, 250, 500, or 1000 nucleotides upstream of a biallelic marker of the invention in said sequence or at any other location which is appropriate for their intended use in sequencing, amplification or the location of novel sequences or markers. Primers with their 3' ends located 1 nucleotide upstream of an biallelic marker of the invention have a special utility as microsequencing assays. Preferred microsequencing primers are described in Table 6.

The probes of the present invention may be designed from the disclosed sequences for any method known in the art, particularly methods which allow for testing if a particular sequence or marker disclosed herein is present. A preferred set of probes may be designed for use in the hybridization assays of the invention in any manner known in the art such that they selectively bind to one allele of a biallelic marker or other polymorphism, but not the other under any particular set of assay conditions. Preferred hybridization probes may consists of, consist essentially of, or comprise a contiguous span which ranges in length from 8, 10, 12, 15, 18 or 20 to 25, 35, 40, 50, 60, 70, or 80 nucleotides, or be specified as being 12, 15, 18, 20, 25, 35, 40, or 50 nucleotides in length and including an biallelic marker or other polymorphism of the invention in said sequence. In a preferred embodiment, either of allele I or 2 disclosed in Table 5 may be specified as being present at the biallelic marker site. In another preferred embodiment, said biallelic marker may be within 6, 5, 4, 3, 2, or 1 nucleotides of the center of the hybridization probe or at the center of said probe.

In one embodiment the invention encompasses isolated, purified, and recombinant polynucleotides comprising, consisting of, or consisting essentially of a contiguous span of 8 to 50 nucleotides of any one of SEQ ID Nos 1 to 17, 24, 25, 28, 74 and 79 to 132 and the complement thereof, wherein said span includes a biallelic marker of the invention, a chromosome 13q31–q33-related biallelic marker or g35030-related biallelic marker in said sequence; optionally, wherein said polymorphism or biallelic marker selected from the group consisting of A1 to A127, and the complements thereof, or optionally the biallelic markers in linkage disequilibrium therewith; optionally, wherein said biallelic marker is selected from the group consisting of A13 to A18, A20 to A46, A49 to A52, A55, A57, A59 to A63, A72 to A73, A76 and A123; optionally, wherein said biallelic marker is selected from the group consisting of A13 to A65, and the complements thereof, or optionally the biallelic markers in linkage disequilibrium therewith; optionally, wherein said contiguous span is 18 to 35 nucleotides in length and said biallelic marker is within 4 nucleotides of the center of said polynucleotide; optionally, wherein said polynucleotide consists of said contiguous span and said contiguous span is 25 nucleotides in length and said biallelic marker is at the center of said polynucleotide; optionally, wherein the 3' end of said contiguous span is present at the 3' end of said polynucleotide; and optionally, wherein the 3' end of said contiguous span is located at the 3' end of said polynucleotide and said biallelic marker is present at the 3' end of said polynucleotide. In a preferred embodiment, said probes comprise, consists of, or consists essentially of a sequence selected from the following sequences: P1 to P127 and the complementary sequences thereto.

In another embodiment the invention encompasses isolated, purified and recombinant polynucleotides comprising, consisting of, or consisting essentially of a contiguous span of 8 to 50 nucleotides of any one of SEQ ID Nos 1 to 17, 24, 25, 28, 74 and 79 to 132, or the complement thereof, wherein the 3' end of said contiguous span is located at the 3' end of said polynucleotide, and wherein the 3' end of said polynucleotide is located within 20 nucleotides upstream of a polymorphism of the invention, chromosome 13q31–q33-related biallelic marker, or g35030-related biallelic marker in said sequence; optionally, wherein said polymorphism or biallelic marker is selected from the group consisting of A1 to A127, and the complements thereof, or optionally the biallelic markers in linkage disequilibrium therewith; optionally, wherein said biallelic marker is selected from the group consisting of A13 to A18, A20 to A46, A49 to A52, A55, A57, A59 to A63, A72 to A73, A76 and A123 , and the complements thereof, or optionally the biallelic markers in linkage disequilibrium therewith; optionally, wherein said biallelic marker is selected from the group consisting of A13 to A65; optionally, wherein the 3' end of said polynucleotide is located 1 nucleotide upstream of said polymorphism or biallelic marker; and optionally, wherein said polynucleotide comprises, consists of, or consists essentially of a sequence selected from the following sequences: D1 to D127 and E1 to E127.

In a further embodiment, the invention encompasses isolated, purified, or recombinant polynucleotides comprising, consisting of, or consisting essentially of a sequence selected from the following sequences: B1 to B114 and C1 to C114.

In an additional embodiment, the invention encompasses polynucleotides for use in hybridization assays, sequencing assays, and enzyme-based mismatch detection assays for determining the identity of the nucleotide at a polymorphism or biallelic marker in any of SEQ ID Nos. 1 to 17, 24, 25, 28, 74 and 79 to 132 or the complement thereof, as well as polynucleotides for use in amplifying segments of nucleotides comprising a polymophism or biallelic marker of the invention in any of SEQ ID Nos 1 to 17, 24, 25, 28, 74 and 79 to 132 or the complement thereof; optionally, wherein said polymorphism or biallelic marker is selected from the group consisting of A1 to A127, and the complements thereof, or optionally the biallelic markers in linkage disequilibrium therewith; optionally, wherein said biallelic marker is selected from the group consisting of A13 to A18, A20 to A46, A49 to A52, A55, A57, A59 to A63, A72 to A73, A76 and A123 , and the complements thereof, or optionally the biallelic markers in linkage disequilibrium therewith; optionally, wherein said biallelic marker is selected from the group consisting of A13 to A65, and the complements thereof, or optionally the biallelic markers in linkage disequilibrium therewith.

These arrays may generally be produced using mechanical synthesis methods or light directed synthesis methods, which incorporate a combination of photolithographic methods and solid phase oligonucleotide synthesis (Fodor et al., Science, 251:767–777, 1991). The immobilization of arrays of oligonucleotides on solid supports has been rendered possible by the development of a technology generally identified as "Very Large Scale Immobilized Polymer Synthesis" (VLSIPS™) in which, typically, probes are immobilized in a high density array on a solid surface of a chip. Examples of VLSIPS™ technologies are provided in U.S. Pat. Nos. 5,143,854 and 5,412,087 and in PCT Publications WO 90/15070, WO 92/10092 and WO 95/11995, which describe methods for forming oligonucleotide arrays through techniques such as light-directed synthesis technique. In designing strategies aimed at providing arrays of nucleotides immobilized on solid supports, further presentation strategies were developed to order and display the oligonucleotide arrays on the chips in an attempt to maximize hybridization patterns and sequence information. Examples of such presentation strategies are disclosed in PCT Publications WO 94/12305, WO 94/11530, WO 97/29212 and WO 97/31256.

Oligonucleotide arrays may comprise at least one of the sequences selected from the group consisting of SEQ ID Nos. 1 to 17, 24, 25, 28, 74 and 79 to 132; and the sequences complementary thereto or a fragment thereof of at least 8, 10, 12, 15, 18, 20, 25, 35, 40, 50, 70, 80, 100, 250, 500 , 1000 or 2000 consecutive nucleotides, to the extent that fragments of these lengths is consistent with the lengths of the particular Sequence ID, for determining whether a sample contains one or more alleles of the biallelic markers of the present invention. Oligonucleotide arrays may also comprise at least one of the sequences selected from the group consisting of SEQ ID Nos. 1 to 17, 24, 25, 28, 74 and 79 to 132; and the sequences complementary thereto or a fragment thereof of at least 8, 10, 12, 15, 18, 20, 25, 35, 40, 50, 70, 80, 100, 250, 500, 1000 or 2000 consecutive nucleotides, to the extent that fragments of these lengths is consistent with the lengths of the particular Sequence ID, for amplifying one or more alleles of the biallelic markers of Table 5. In other embodiments, arrays may also comprise at least one of the sequences selected from the group consisting of SEQ ID Nos. 1 to 17, 24, 25, 28, 74 and 79 to 132; and the sequences complementary thereto or a fragment thereof of at least 8, 10, 12, 15, 18, 20, 25, 35, 40, 50, 70, 80, 100, 250, 500, 1000 or 2000 consecutive nucleotides, to the extent that fragments of these lengths is consistent with the lengths of the particular Sequence ID, for conducting microsequencing analyses to determine whether a sample contains one or more alleles of the biallelic markers of the invention. In still further embodiments, the oligonucleotide array may comprise at least one of the sequences selecting from the group consisting of SEQ ID Nos. 1 to 17, 24, 25, 28, 74 and 79 to 132; and the sequences complementary thereto or a fragment thereof of at least 8, 10, 12, 15, 18, 20, 25, 35, 40, 50, 70, 80, 100, 250, 500, 1000 or 2000 nucleotides in length, to the extent that fragments of these lengths is consistent with the lengths of the particular Sequence ID, for determining whether a sample contains one or more alleles of the polymorphisms and biallelic markers of the present invention.

A further object of the invention relates to an array of nucleic acid sequences comprising either at least one of the sequences selected from the group consisting of P1 to P127, B1 to B114, C1 to C114, D1 to D127 E1 to E127 or the sequences complementary thereto or a fragment thereof of at least 8, 10, 12, 15, 18, 20, 25, 30, or 40 consecutive nucleotides thereof, or at least one sequence comprising at least 1, 2, 3, 4, 5, 10, 20 biallelic markers selected from the group consisting of A1 to A127 or the complements thereof. The invention also pertains to an array of nucleic acid sequences comprising either at least 1, 2, 3, 4, 5, 10, 20 of the sequences selected from the group consisting of P1 to P127,B1 to B114,C1 to C114, D1 to D127, E1 to E127 or the sequences complementary thereto or a fragment thereof of at least 8 consecutive nucleotides thereof, or at least two sequences comprising a biallelic marker selected from the group consisting of A1 to A127 or the complements thereto. In preferred embodiments, said biallelic markers are selected from the group consisting of A13 to A18, A20 to A46, A49 to A52, A55, A57, A59 to A63, A72 to A73, A76 and A123 . In preferred embodiments, said probes, amplification primers and microsequencing primers correspond in Table 6 to said biallelic markers.

The present invention also encompasses diagnostic kits comprising one or more polynucleotides of the invention, optionally with a portion or all of the necessary reagents and instructions for genotyping a test subject by determining the identity of a nucleotide at an biallelic marker of the invention. The polynucleotides of a kit may optionally be attached to a solid support, or be part of an array or addressable array of polynucleotides. The kit may provide for the determination of the identity of the nucleotide at a marker position by any method known in the art including, but not limited to, a sequencing assay method, a microsequencing assay method, a hybridization assay method, or enzyme-based mismatch detection assay. Optionally such a kit may include instructions for scoring the results of the determination with respect to the test subjects' predisposition to schizophrenia, or likely response to an agent acting on schizophrenia, or chances of suffering from side effects to an agent acting on schizophrenia.

Optionally, in any embodiments described herein, a biallelic marker of the invention may comprise:

(a) a biallelic marker selected from the group consisting of g35030-related markers A13 to A65; (b) a biallelic marker selected from the group consisting of chromosome 13q31–q33-related-biallelic markers A13 to A18, A20 to A46, A49 to A52, A55, A57, A59 to A63, A72 to A73, A76 and A123; or (c) a biallelic marker selected from the group consisting of chromosome 13q31–q33-related-biallelic markers A13 to A18, A20 to A47, A49 to A52, A55, A57, a59, to A63. Furthermore, any of the embodiments of the invention may specifically exclude one or more of the biallelic markers selected from biallelic markers A1 to A127.

Methods for De Novo Identification of Biallelic Markers

Any of a variety of methods can be used to screen a genomic fragment for single nucleotide polymorphisms such as differential hybridization with oligonucleotide probes, detection of changes in the mobility measured by gel electrophoresis or direct sequencing of the amplified nucleic acid. A preferred method for identifying biallelic markers involves comparative sequencing of genomic DNA fragments from an appropriate number of unrelated individuals.

In a first embodiment, DNA samples from unrelated individuals are pooled together, following which the genomic DNA of interest is amplified and sequenced. The nucleotide sequences thus obtained are then analyzed to identify significant polymorphisms. One of the major advantages of this method resides in the fact that the pooling of the DNA samples substantially reduces the number of DNA amplification reactions and sequencing reactions, which must be carried out. Moreover, this method is sufficiently sensitive so that a biallelic marker obtained thereby usually demonstrates a sufficient frequency of its less common allele to be useful in conducting association studies. Usually, the frequency of the least common allele of a biallelic marker identified by this method is at least 10%.

In a second embodiment, the DNA samples are not pooled and are therefore amplified and sequenced individually. This method is usually preferred when biallelic markers need to be identified in order to perform association studies within candidate genes. Preferably, highly relevant gene regions such as promoter regions or exon regions may be screened for biallelic markers. A biallelic marker obtained using this method may show a lower degree of informativeness for conducting association studies, e.g. if the frequency of its less frequent allele may be less than about 10%. Such a biallelic marker will however be sufficiently informative to conduct association studies and it will further be appreciated that including less informative biallelic markers in the genetic analysis studies of the present invention, may allow in some cases the direct identification of causal mutations, which may, depending on their penetrance, be rare mutations.

The following is a description of the various parameters of a preferred method used by the inventors for the identification of the biallelic markers of the present invention.

Genomic DNA Samples

The genomic DNA samples from which the biallelic markers of the present invention are generated are preferably obtained from unrelated individuals corresponding to a heterogeneous population of known ethnic background. The number of individuals from whom DNA samples are obtained can vary substantially, preferably from about 10 to about 1000, more preferably from about 50 to about 200 individuals. Usually, DNA samples are collected from at least about 100 individuals in order to have sufficient polymorphic diversity in a given population to identify as many markers as possible and to generate statistically significant results.

As for the source of the genomic DNA to be subjected to analysis, any test sample can be foreseen without any particular limitation. These test samples include biological samples, which can be tested by the methods of the present invention described herein, and include human and animal body fluids such as whole blood, serum, plasma, cerebrospinal fluid, urine, lymph fluids, and various external secretions of the respiratory, intestinal and genitourinary tracts, tears, saliva, milk, white blood cells, myelomas and the like; biological fluids such as cell culture supernatants; fixed tissue specimens including tumor and non-tumor tissue and lymph node tissues; bone marrow aspirates and fixed cell specimens. The preferred source of genomic DNA used in the present invention is from peripheral venous blood of each donor. Techniques to prepare genomic DNA from biological samples are well known to the skilled technician. Details of a preferred embodiment are provided in Example 1. The person skilled in the art can choose to amplify pooled or unpooled DNA samples.

DNA Amplification

The identification of biallelic markers in a sample of genomic DNA may be facilitated through the use of DNA amplification methods. DNA samples can be pooled or unpooled for the amplification step. DNA amplification techniques are well known to those skilled in the art. Various methods to amplify DNA fragments carrying biallelic markers are further described hereinafter herein. The PCR technology is the preferred amplification technique used to identify new biallelic markers.

In a first embodiment, biallelic markers are identified using genomic sequence information generated by the inventors. Genomic DNA fragments, such as the inserts of the BAC clones described above, are sequenced and used to design primers for the amplification of 500 bp fragments. These 500 bp fragments are amplified from genomic DNA and are scanned for biallelic markers. Primers may be designed using the OSP software (Hillier L. and Green P., 1991). All primers may contain, upstream of the specific target bases, a common oligonucleotide tail that serves as a sequencing primer. Those skilled in the art are familiar with primer extensions, which can be used for these purposes.

In another embodiment of the invention, genomic sequences of candidate genes are available in public databases allowing direct screening for biallelic markers. Preferred primers, useful for the amplification of genomic sequences encoding the candidate genes, focus on promoters, exons and splice sites of the genes. A biallelic marker present in these functional regions of the gene have a higher probability to be a causal mutation.

Sequencing of Amplified Genomic DNA and Identification of Single Nucleotide Polymorphisms The amplification products generated as described above, are then sequenced using any method known and available to the skilled technician. Methods for sequencing DNA using either the dideoxy-mediated method (Sanger method) or the Maxam-Gilbert method are widely known to those of ordinary skill in the art. Such methods are for example disclosed in Maniatis et al. (Molecular Cloning, A Laboratory Manual, Cold Spring Harbor Press, Second Edition, 1989). Alternative approaches include hybridization to high-density DNA probe arrays as described in Chee et al. (Science 274, 610, 1996).

Preferably, the amplified DNA is subjected to automated dideoxy terminator sequencing reactions using a dye-primer cycle sequencing protocol. The products of the sequencing reactions are run on sequencing gels and the sequences are determined using gel image analysis. The polymorphism search is based on the presence of superimposed peaks in the electrophoresis pattern resulting from different bases occurring at the same position. Because each dideoxy terminator is labeled with a different fluorescent molecule, the two peaks corresponding to a biallelic site present distinct colors corresponding to two different nucleotides at the same position on the sequence. However, the presence of two peaks can be an artifact due to background noise. To exclude such an artifact, the two DNA strands are sequenced and a comparison between the peaks is carried out. In order to be registered as a polymorphic sequence, the polymorphism has to be detected on both strands.

The above procedure permits those amplification products, which contain biallelic markers to be identified. The detection limit for the frequency of biallelic polymorphisms detected by sequencing pools of 100 individuals is approximately 0.1 for the minor allele, as verified by sequencing pools of known allelic frequencies. However, more than 90% of the biallelic polymorphisms detected by the pooling method have a frequency for the minor allele higher than 0.25. Therefore, the biallelic markers selected by this method have a frequency of at least 0.1 for the minor allele and less than 0.9 for the major allele. Preferably at least 0.2 for the minor allele and less than 0.8 for the major allele, more preferably at least 0.3 for the minor allele and less than 0.7 for the major allele, thus a heterozygosity rate higher than 0.18, preferably higher than 0.32, more preferably higher than 0.42.

In another embodiment, biallelic markers are detected by sequencing individual DNA samples, the frequency of the minor allele of such a biallelic marker may be less than 0.1.

Validation of the Biallelic Markers of the Present Invention

The polymorphisms are evaluated for their usefulness as genetic markers by validating that both alleles are present in a population. Validation of the biallelic markers is accomplished by genotyping a group of individuals by a method of the invention and demonstrating that both alleles are present. Microsequencing is a preferred method of genotyping alleles. The validation by genotyping step may be performed on individual samples derived from each individual in the group or by genotyping a pooled sample derived from more than one individual. The group can be as small as one individual if that individual is heterozygous for the allele in question. Preferably the group contains at least three individuals, more preferably the group contains five or six individuals, so that a single validation test will be more likely to result in the validation of more of the biallelic markers that are being tested. It should be noted, however, that when the validation test is performed on a small group it may result in a false negative result if as a result of sampling error none of the individuals tested carries one of the two alleles. Thus, the validation process is less useful in demonstrating that a particular initial result is an artifact, than it is at demonstrating that there is a bona fide biallelic marker at a particular position in a sequence. All of the genotyping, haplotyping, association, and interaction study methods of the invention may optionally be performed solely with validated biallelic markers.

Evaluation of the Frequency of the Biallelic Markers of the Present Invention

The validated biallelic markers are further evaluated for their usefulness as genetic markers by determining the frequency of the least common allele at the biallelic marker site. The determination of the least common allele is accomplished by genotyping a group of individuals by a method of the invention and demonstrating that both alleles are present. This determination of frequency by genotyping step may be performed on individual samples derived from each individual in the group or by genotyping a pooled sample derived from more than one individual. The group must be large enough to be representative of the population as a whole. Preferably the group contains at least 20 individuals, more preferably the group contains at least 50 individuals, most preferably the group contains at least 100 individuals. Of course the larger the group the greater the accuracy of the frequency determination because of reduced sampling error. A biallelic marker wherein the frequency of the less common allele is 30% or more is termed a "high quality biallelic marker." All of the genotyping, haplotyping, association, and interaction study methods of the invention may optionally be performed solely with high quality biallelic markers.

Another embodiment of the invention comprises methods of estimating the frequency of an allele in a population comprising genotyping individuals from said population for a 13q31–q33-related biallelic marker and determining the proportional representation of said biallelic marker in said population. In addition, the methods of estimating the frequency of an allele in a population encompass methods with any further limitation described in this disclosure, or those following, specified alone or in any combination: Optionally, said 13q31–q33-related biallelic marker may be in a sequence selected individually or in any combination from the group consisting of SEQ Nos 1 to 17, 24, 25, 28, 74 and 79 to 132; and the complements thereof; optionally, said 13q31–q33-related biallelic marker may be selected from the biallelic markers described in Table 5; optionally, determining the frequency of a biallelic marker allele in a population may be accomplished by determining the identity of the nucleotides for both copies of said biallelic marker present in the genome of each individual in said population and calculating the proportional representation of said nucleotide at said 13q31–q33-related biallelic marker for the population; optionally, determining the frequency of a biallelic marker allele in a population may be accomplished by performing a genotyping method on a pooled biological sample derived from a representative number of individuals, or each individual, in said population, and calculating the proportional amount of said nucleotide compared with the total.

Methods of Genotyping an Individual for Biallelic Markers

Methods are provided to genotype a biological sample for one or more biallelic markers of the present invention, all of which may be performed in vitro. Such methods of genotyping comprise determining the identity of a nucleotide at an biallelic marker of the invention by any method known in the art. These methods find use in genotyping case-control populations in association studies as well as individuals in the context of detection of alleles of biallelic markers which, are known to be associated with a given trait, in which case both copies of the biallelic marker present in individual's genome are determined so that an individual may be classified as homozygous or heterozygous for a particular allele.

These genotyping methods can be performed nucleic acid samples derived from a single individual or pooled DNA samples.

Genotyping can be performed using similar methods as those described above for the identification of the biallelic markers, or using other genotyping methods such as those further described below. In preferred embodiments, the comparison of sequences of amplified genomic fragments from different individuals is used to identify new biallelic markers whereas microsequencing is used for genotyping known biallelic markers in diagnostic and association study applications.

Another embodiment of the invention encompasses methods of genotyping a biological sample comprising determining the identity of a nucleotide at a 13q31–q33-related biallelic marker. Thus, the invention encompasses a method of genotyping an individual comprising: (a) obtaining a biological sample comprising a nucleic acid from said individual; (b) determining the identity of a polymorphic base at a biallelic marker from said nucleic acid; wherein said polymorphic base is selected from the group consisting of the first or second respective allele at the nucleotide position of the polymorphic base of SEQ ID No 1, 24, 25, 28, or 74 as indicated in table 5; wherein the identity of the polymorphic base determines the genotype of the individual at said position.

In addition, the genotyping methods of the invention encompass methods with any further limitation described in this disclosure, or those following, specified alone or in any combination: Optionally, said 13q31–q33-related biallelic marker may be in a sequence selected individually or in any combination from the group consisting of SEQ ID Nos 1 to 17, 24, 25, 28, 74 and 79 to 132, and the complements thereof; optionally, said 13q31–q33-related biallelic marker may be selected individually or in any combination from the biallelic markers described in Table 5; optionally, said method further comprises determining the identity of a second nucleotide at said biallelic marker, wherein said first nucleotide and second nucleotide are not base paired (by Watson & Crick base pairing) to one another; optionally, said biological sample is derived from a single individual or subject; optionally, said method is performed in vitro; optionally, said biallelic marker is determined for both copies of said biallelic marker present in said individual's genome; optionally, said biological sample is derived from multiple subjects or individuals; optionally, said method further comprises amplifying a portion of said sequence comprising the biallelic marker prior to said determining step; optionally, wherein said amplifying is performed by PCR, LCR, or replication of a recombinant vector comprising an origin of replication and said portion in a host cell; optionally, wherein said determining is performed by a hybridization assay, sequencing assay, microsequencing assay, or an enzyme-based mismatch detection assay.

Source of DNA for Genotyping

Any source of nucleic acids, in purified or non-purified form, can be utilized as the starting nucleic acid, provided it contains or is suspected of containing the specific nucleic acid sequence desired. DNA or RNA may be extracted from cells, tissues, body fluids and the like as described herein. While nucleic acids for use in the genotyping methods of the invention can be derived from any mammalian source, the test subjects and individuals from which nucleic acid samples are taken are generally understood to be human.

Amplification of DNA Fragments Comprising Biallelic Markers

Methods and polynucleotides are provided to amplify a segment of nucleotides comprising one or more biallelic marker of the present invention. It will be appreciated that amplification of DNA fragments comprising biallelic markers may be used in various methods and for various purposes and is not restricted to genotyping. Nevertheless, many genotyping methods, although not all, require the previous amplification of the DNA region carrying the biallelic marker of interest. Such methods specifically increase the concentration or total number of sequences that span the biallelic marker or include that site and sequences located either distal or proximal to it. Diagnostic assays may also rely on amplification of DNA segments carrying a biallelic marker of the present invention.

Amplification of DNA may be achieved by any method known in the art. The established PCR (polymerase chain reaction) method or by developments thereof or alternatives. Amplification methods which can be utilized herein include but are not limited to Ligase Chain Reaction (LCR) as described in EP A 320 308 and EP A 439 182, Gap LCR (Wolcott, M. J.), the so-called "NASBA" or "3SR" technique described in Guatelli J. C. et al. (1990) and in Compton J. (1991), Q-beta amplification as described in EP A 4544 610, strand displacement amplification as described in Walker et al. (1996) and EP A 684 315 and, target mediated amplification as described in PCT Publication WO 9322461.

LCR and Gap LCR are exponential amplification techniques, both depend on DNA ligase to join adjacent primers annealed to a DNA molecule. In Ligase Chain Reaction (LCR), probe pairs are used which include two primary (first and second) and two secondary (third and fourth) probes, all of which are employed in molar excess to target. The first probe hybridizes to a first segment of the target strand and the second probe hybridizes to a second segment of the target strand, the first and second segments being contiguous so that the primary probes abut one another in 5' phosphate-3'hydroxyl relationship, and so that a ligase can covalently fuse or ligate the two probes into a fused product. In addition, a third (secondary) probe can hybridize to a portion of the first probe and a fourth (secondary) probe can hybridize to a portion of the second probe in a similar abutting fashion. Of course, if the target is initially double stranded, the secondary probes also will hybridize to the target complement in the first instance. Once the ligated strand of primary probes is separated from the target strand, it will hybridize with the third and fourth probes which can be ligated to form a complementary, secondary ligated product. It is important to realize that the ligated products are functionally equivalent to either the target or its complement. By repeated cycles of hybridization and ligation, amplification of the target sequence is achieved. A method for multiplex LCR has also been described (WO 9320227). Gap LCR (GLCR) is a version of LCR where the probes are not adjacent but are separated by 2 to 3 bases.

For amplification of mRNAs, it is within the scope of the present invention to reverse transcribe mRNA into cDNA followed by polymerase chain reaction (RT-PCR); or, to use a single enzyme for both steps as described in U.S. Pat. No. 5,322,770 or, to use Asymmetric Gap LCR (RT-AGLCR) as described by Marshall R. L. et al. (1994). AGLCR is a modification of GLCR that allows the amplification of RNA.

Some of these amplification methods are particularly suited for the detection of single nucleotide polymorphisms and allow the simultaneous amplification of a target sequence and the identification of the polymorphic nucleotide as it is further described herein.

The PCR technology is the preferred amplification technique used in the present invention. A variety of PCR techniques are familiar to those skilled in the art. For a review of PCR technology, see Molecular Cloning to Genetic Engineering White, B. A. Ed. (1997) and the publication entitled "PCR Methods and Applications" (1991, Cold Spring Harbor Laboratory Press). In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites. PCR has further been described in several patents including U.S. Pat. Nos. 4,683,195, 4,683,202 and 4,965,188.

Primers can be prepared by any suitable method. As for example, direct chemical synthesis by a method such as the phosphodiester method of Narang S. A. et al. (1979), the phosphodiester method of Brown E. L. et al. (1979), the diethylphosphoramidite method of Beaucage et al. (1981) and the solid support method described in EP 0 707 592.

In some embodiments the present invention provides primers for amplifying a DNA fragment containing one or more biallelic markers of the present invention. It will be appreciated that the primers listed are merely exemplary and that any other set of primers which produce amplification products containing one or more biallelic markers of the present invention.

The spacing of the primers determines the length of the segment to be amplified. In the context of the present invention amplified segments carrying biallelic markers can range in size from at least about 25 bp to 35 kbp. Amplification fragments from 25–3000 bp are typical, fragments from 50–1000 bp are preferred and fragments from 100–600 bp are highly preferred. It will be appreciated that amplification primers for the biallelic markers may be any sequence which allow the specific amplification of any DNA fragment carrying the markers. Amplification primers may be labeled or immobilized on a solid support as described in the section titled "Oligonucleotide Probes and Primers".

Methods of Genotyping DNA Samples for Biallelic Markers

Any method known in the art can be used to identify the nucleotide present at a biallelic marker site. Since the biallelic marker allele to be detected has been identified and specified in the present invention, detection will prove simple for one of ordinary skill in the art by employing any of a number of techniques. Many genotyping methods require the previous amplification of the DNA region carrying the biallelic marker of interest. While the amplification of target or signal is often preferred at present, ultrasensitive detection methods which do not require amplification are also encompassed by the present genotyping methods. Methods well-known to those skilled in the art that can be used to detect biallelic polymorphisms include methods such as, conventional dot blot analyzes, single strand conformational polymorphism analysis (SSCP) described by Orita et al. (1989), denaturing gradient gel electrophoresis (DGGE), heteroduplex analysis, mismatch cleavage detection, and other conventional techniques as described in Sheffield, V. C. et al. (1991), White et al. (1992), Grompe, M. et al. (1989) and Grompe, M. (1993). Another method for determining the identity of the nucleotide present at a particular polymorphic site employs a specialized exonuclease-resistant nucleotide derivative as described in U.S. Pat. No. 4,656,127.

Preferred methods involve directly determining the identity of the nucleotide present at a biallelic marker site by sequencing assay, enzyme-based mismatch detection assay, or hybridization assay. The following is a description of some preferred methods. A highly preferred method is the microsequencing technique. The term "sequencing assay" is used herein to refer to polymerase extension of duplex primer/template complexes and includes both traditional sequencing and microsequencing.

1) Sequencing Assays

The nucleotide present at a polymorphic site can be determined by sequencing methods. In a preferred embodiment, DNA samples are subjected to PCR amplification before sequencing as described above. DNA sequencing methods are described in herein. Preferably, the amplified DNA is subjected to automated dideoxy terminator sequencing reactions using a dye-primer cycle sequencing protocol. Sequence analysis allows the identification of the base present at the biallelic marker site.

2) Microsequencing Assays

In microsequencing methods, a nucleotide at the polymorphic site that is unique to one of the alleles in a target DNA is detected by a single nucleotide primer extension reaction. This method involves appropriate microsequencing primers which, hybridize just upstream of a polymorphic base of interest in the target nucleic acid. A polymerase is used to specifically extend the 3' end of the primer with one single ddNTP (chain terminator) complementary to the selected nucleotide at the polymorphic site. Next the identity of the incorporated nucleotide is determined in any suitable way.

Typically, microsequencing reactions are carried out using fluorescent ddNTPs and the extended microsequencing primers are analyzed by electrophoresis on ABI 377 sequencing machines to determine the identity of the incorporated nucleotide as described in EP 412 883. Alternatively capillary electrophoresis can be used in order to process a higher number of assays simultaneously. An example of a typical microsequencing procedure that can be used in the context of the present invention is provided in example 4.

Different approaches can be used to detect the nucleotide added to the microsequencing primer. A homogeneous phase detection method based on fluorescence resonance energy transfer has been described by Chen and Kwok (1997) and Chen et al. (1997). In this method amplified genomic DNA fragments containing polymorphic sites are incubated with a 5'-fluorescein-labeled primer in the presence of allelic dye-labeled dideoxyribonucleoside triphosphates and a modified Taq polymerase. The dye-labeled primer is extended one base by the dye-terminator specific for the allele present on the template. At the end of the genotyping reaction, the fluorescence intensities of the two dyes in the reaction mixture are analyzed directly without separation or purification. All these steps can be performed in the same tube and the fluorescence changes can be monitored in real time. Alternatively, the extended primer may be analyzed by MALDI-TOF Mass Spectrometry. The base at the polymorphic site is identified by the mass added onto the microsequencing primer (see Haff L. A. and Smirnov I. P., 1997).

Microsequencing may be achieved by the established microsequencing method or by developments or derivatives thereof. Alternative methods include several solid-phase microsequencing techniques. The basic microsequencing protocol is the same as described previously, except that the method is conducted as a heterogenous phase assay, in which the primer or the target molecule is immobilized or captured onto a solid support. To simplify the primer separation and the terminal nucleotide addition analysis, oligonucleotides are attached to solid supports or are modified in such ways that permit affinity separation as well as polymerase extension. The 5' ends and internal nucleotides of synthetic oligonucleotides can be modified in a number of different ways to permit different affinity separation approaches, e.g., biotinylation. If a single affinity group is used on the oligonucleotides, the oligonucleotides can be separated from the incorporated terminator regent. This eliminates the need of physical or size separation. More than one oligonucleotide can be separated from the terminator reagent and analyzed simultaneously if more than one affinity group is used. This permits the analysis of several nucleic acid species or more nucleic acid sequence information per extension reaction. The affinity group need not be on the priming oligonucleotide but could alternatively be present on the template. For example, immobilization can be carried out via an interaction between biotinylated DNA and streptavidin-coated microtitration wells or avidin-coated polystyrene particles. In the same manner oligonucleotides or templates may be attached to a solid support in a high-density format. In such solid phase microsequencing reactions, incorporated ddNTPs can be radiolabeled (Syvänen, 1994) or linked to fluorescein (Livak and Hainer, 1994). The detection of radiolabeled ddNTPs can be achieved through scintillation-based techniques. The detection of fluorescein-linked ddNTPs can be based on the binding of antifluorescein antibody conjugated with alkaline phosphatase, followed by incubation with a chromogenic substrate (such as p-nitrophenyl phosphate). Other possible reporter-detection pairs include: ddNTP linked to dinitrophenyl (DNP) and anti-DNP alkaline phosphatase conjugate (Harju et al., 1993) or biotinylated ddNTP and horseradish peroxidase-conjugated streptavidin with o-phenylenediamine as a substrate (WO 92/15712). As yet another alternative solid-phase microsequencing procedure, Nyren et al. (1993) described a method relying on the detection of DNA polymerase activity by an enzymatic luminometric inorganic pyrophosphate detection assay (ELIDA).

Pastinen et al. (1997), describe a method for multiplex detection of single nucleotide polymorphism in which the solid phase minisequencing principle is applied to an oligonucleotide array format. High-density arrays of DNA probes attached to a solid support (DNA chips) are further described in herein.

In one aspect the present invention provides polynucleotides and methods to genotype one or more biallelic markers of the present invention by performing a microsequencing assay. Preferred microsequencing primers include those being featured Table 6. It will be appreciated that the microsequencing primers listed in Table 6 are merely exemplary and that, any primer having a 3' end immediately adjacent to a polymorphic nucleotide may be used. Similarly, it will be appreciated that microsequencing analysis may be performed for any biallelic marker or any combination of biallelic markers of the present invention. One aspect of the present invention is a solid support which includes one or more microsequencing primers listed in Table 6, or fragments comprising at least 8, at least 12, at least 15, or at least 20 consecutive nucleotides thereof and having a 3' terminus immediately upstream of the corresponding biallelic marker, for determining the identity of a nucleotide at biallelic marker site.

3) Mismatch Detection Assays Based on Polymerases and Ligases

In one aspect the present invention provides polynucleotides and methods to determine the allele of one or more biallelic markers of the present invention in a biological sample, by mismatch detection assays based on polymerases and/or ligases. These assays are based on the specificity of polymerases and ligases. Polymerization reactions places particularly stringent requirements on correct base pairing of the 3' end of the amplification primer and the joining of two oligonucleotides hybridized to a target DNA sequence is quite sensitive to mismatches close to the ligation site, especially at the 3' end. The terms "enzyme based mismatch detection assay" are used herein to refer to any method of determining the allele of a biallelic marker based on the specificity of ligases and polymerases. Preferred methods are described below. Methods, primers and various parameters to amplify DNA fragments comprising biallelic markers of the present invention are further described herein.

Allele Specific Amplification

Discrimination between the two alleles of a biallelic marker can also be achieved by allele specific amplification, a selective strategy, whereby one of the alleles is amplified without amplification of the other allele. This is accomplished by placing a polymorphic base at the 3' end of one of the amplification primers. Because the extension forms from the 3' end of the primer, a mismatch at or near this position has an inhibitory effect on amplification. Therefore, under appropriate amplification conditions, these primers only direct amplification on their complementary allele. Designing the appropriate allele-specific primer and the corresponding assay conditions are well with the ordinary skill in the art.

Ligation/Amplification Based Methods

The "Oligonucleotide Ligation Assay" (OLA) uses two oligonucleotides which are designed to be capable of hybridizing to abutting sequences of a single strand of a target molecules. One of the oligonucleotides is biotinylated, and the other is detectably labeled. If the precise complementary sequence is found in a target molecule, the oligonucleotides will hybridize such that their termini abut, and create a ligation substrate that can be captured and detected. OLA is capable of detecting biallelic markers and may be advantageously combined with PCR as described by Nickerson D. A. et al. (1990). In this method, PCR is used to achieve the exponential amplification of target DNA, which is then detected using OLA.

Other methods which are particularly suited for the detection of biallelic markers include LCR (ligase chain reaction), Gap LCR (GLCR) which are described herein. As mentioned above LCR uses two pairs of probes to exponentially amplify a specific target. The sequences of each pair of oligonucleotides, is selected to permit the pair to hybridize to abutting sequences of the same strand of the target. Such hybridization forms a substrate for a template-dependant ligase. In accordance with the present invention, LCR can be performed with oligonucleotides having the proximal and distal sequences of the same strand of a biallelic marker site. In one embodiment, either oligonucleotide will be designed to include the biallelic marker site. In such an embodiment, the reaction conditions are selected such that the oligonucleotides can be ligated together only if the target molecule either contains or lacks the specific nucleotide(s) that is complementary to the biallelic marker on the oligonucleotide. In an alternative embodiment, the oligonucleotides will not include the biallelic marker, such that when they hybridize to the target molecule, a "gap" is created as described in WO 90/01069. his gap is then "filled" with complementary dNTPs (as mediated by DNA polymerase), or by an additional pair of oligonucleotides. Thus at the end of each cycle, each single strand has a complement capable of serving as a target during the next cycle and exponential allele-specific amplification of the desired sequence is obtained.

Ligase/Polymerase-mediated Genetic Bit Analysis™ is another method for determining the identity of a nucleotide at a preselected site in a nucleic acid molecule (WO 95/21271). This method involves the incorporation of a nucleoside triphosphate that is complementary to the nucleotide present at the preselected site onto the terminus of a primer molecule, and their subsequent ligation to a second oligonucleotide. The reaction is monitored by detecting a specific label attached to the reaction's solid phase or by detection in solution.

4) Hybridization Assay Methods

A preferred method of determining the identity of the nucleotide present at a biallelic marker site involves nucleic acid hybridization. The hybridization probes, which can be conveniently used in such reactions, preferably include the probes defined herein. Any hybridization assay may be used including Southern hybridization, Northern hybridization, dot blot hybridization and solid-phase hybridization (see Sambrook et al., Molecular Cloning—A Laboratory Manual, Second Edition, Cold Spring Harbor Press, N.Y., 1989).

Hybridization refers to the formation of a duplex structure by two single stranded nucleic acids due to complementary base pairing. Hybridization can occur between exactly complementary nucleic acid strands or between nucleic acid strands that contain minor regions of mismatch. Specific probes can be designed that hybridize to one form of a biallelic marker and not to the other and therefore are able to discriminate between different allelic forms. Allele-specific probes are often used in pairs, one member of a pair showing perfect match to a target sequence containing the original allele and the other showing a perfect match to the target sequence containing the alternative allele. Hybridization conditions should be sufficiently stringent that there is a significant difference in hybridization intensity between alleles, and preferably an essentially binary response, whereby a probe hybridizes to only one of the alleles. Stringent, sequence specific hybridization conditions, under which a probe will hybridize only to the exactly complementary target sequence are well known in the art (Sambrook et al., Molecular Cloning—A Laboratory Manual, Second Edition, Cold Spring Harbor Press, N.Y., 1989). Stringent conditions are sequence dependent and will be different in different circumstances. Generally, stringent conditions are selected to be about 5° C. lower than the thermal melting point (Tm) for the specific sequence at a defined ionic strength and pH. By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65° C., the preferred hybridization temperature, in prehybridization mixture containing 100 µg/ml denatured salmon sperm DNA and 5–20×10$^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of high and intermediate stringency which may be used are well known in the art and as cited in Sambrook et al. (Molecular Cloning—A Laboratory Manual, Second Edition, Cold Spring Harbor Press, N.Y., 1989) and Ausubel et al. (Current Protocols in Molecular Biology, Green Publishing Associates and Wiley Interscience, N.Y., 1989).

Although such hybridizations can be performed in solution, it is preferred to employ a solid-phase hybridization assay. The target DNA comprising a biallelic marker of the present invention may be amplified prior to the hybridization reaction. The presence of a specific allele in the sample is determined by detecting the presence or the absence of stable hybrid duplexes formed between the probe and the target DNA. The detection of hybrid duplexes can be carried out by a number of methods. Various detection assay formats are well known which utilize detectable labels bound to either the target or the probe to enable detection of the hybrid duplexes. Typically, hybridization duplexes are separated from unhybridized nucleic acids and the labels bound to the duplexes are then detected. Those skilled in the art will recognize that wash steps may be employed to wash away excess target DNA or probe. Standard heterogeneous assay formats are suitable for detecting the hybrids using the labels present on the primers and probes.

Two recently developed assays allow hybridization-based allele discrimination with no need for separations or washes (see Landegren U. et al., 1998). The TaqMan assay takes advantage of the 5' nuclease activity of Taq DNA polymerase to digest a DNA probe annealed specifically to the accumulating amplification product. TaqMan probes are labeled with a donor-acceptor dye pair that interacts via fluorescence energy transfer. Cleavage of the TaqMan probe by the advancing polymerase during amplification dissociates the donor dye from the quenching acceptor dye, greatly increasing the donor fluorescence. All reagents necessary to detect two allelic variants can be assembled at the beginning of the reaction and the results are monitored in real time (see Livak et al, 1995). In an alternative homogeneous hybridization-based procedure, molecular beacons are used for allele discriminations. Molecular beacons are hairpin-shaped oligonucleotide probes that report the presence of specific nucleic acids in homogeneous solutions. When they bind to their targets they undergo a conformational reorganization that restores the fluorescence of an internally quenched fluorophore (Tyagi et al., 1998).

By assaying the hybridization to an allele specific probe, one can detect the presence or absence of a biallelic marker allele in a given sample.

High-Throughput parallel hybridizations in array format are specifically encompassed within "hybridization assays" and are described below.

Hybridization to Addressable Arrays of Oligonucleotides

Hybridization assays based on oligonucleotide arrays rely on the differences in hybridization stability of short oligonucleotides to perfectly matched and mismatched target sequence variants. Efficient access to polymorphism information is obtained through a basic structure comprising high-density arrays of oligonucleotide probes attached to a solid support (the chip) at selected positions. Each DNA chip can contain thousands to millions of individual synthetic DNA probes arranged in a grid-like pattern and miniaturized to the size of a dime.

The chip technology has already been applied with success in numerous cases. For example, the screening of mutations has been undertaken in the BRCA 1 gene, in *S. cerevisiae* mutant strains, and in the protease gene of HIV-1 virus (Hacia et al., 1996; Shoemaker et al., 1996 ; Kozal et al., 1996). Chips of various formats for use in detecting biallelic polymorphisms can be produced on a customized basis by Affymetrix (GeneChip™), Hyseq (HyChip and HyGnostics), and Protogene Laboratories.

In general, these methods employ arrays of oligonucleotide probes that are complementary to target nucleic acid sequence segments from an individual which, target sequences include a polymorphic marker. EP785280, describes a tiling strategy for the detection of single nucleotide polymorphisms. Briefly, arrays may generally be "tiled" for a large number of specific polymorphisms. By "tiling" is generally meant the synthesis of a defined set of oligonucleotide probes which is made up of a sequence complementary to the target sequence of interest, as well as preselected variations of that sequence, e.g., substitution of one or more given positions with one or more members of the basis set of monomers, i.e. nucleotides. Tiling strategies are further described in PCT application No. WO 95/11995. In a particular aspect, arrays are tiled for a number of specific, identified biallelic marker sequences. In particular the array is tiled to include a number of detection blocks, each detection block being specific for a specific biallelic marker or a set of biallelic markers. For example, a detection block may be tiled to include a number of probes, which span the sequence segment that includes a specific polymorphism. To ensure probes that are complementary to each allele, the probes are synthesized in pairs differing at the biallelic marker. In addition to the probes differing at the polymorphic base, monosubstituted probes are also generally tiled within the detection block. These monosubstituted probes have bases at and up to a certain number of bases in either direction from the polymorphism, substituted with the remaining nucleotides (selected from A, T, G, C and U). Typically the probes in a tiled detection block will include substitutions of the sequence positions up to and including those that are 5 bases away from the biallelic marker. The monosubstituted probes provide internal controls for the tiled array, to distinguish actual hybridization from artefactual cross-hybridization. Upon completion of hybridization with the target sequence and washing of the array, the array is scanned to determine the position on the array to which the target sequence hybridizes. The hybridization data from the scanned array is then analyzed to identify which allele or alleles of the biallelic marker are present in the sample. Hybridization and scanning may be carried out as described in PCT application No. WO 92/10092 and WO 95/11995 and U.S. Pat. No. 5,424,186.

Thus, in some embodiments, the chips may comprise an array of nucleic acid sequences of fragments of about 15 nucleotides in length. In further embodiments, the chip may comprise an array including at least one of the sequences selected from the group consisting of SEQ ID Nos. 1 to 17, 24, 25, 28, 74 and 79 to 132 and the sequences complementary thereto, or a fragment thereof at least about 8 consecutive nucleotides, preferably 10, 15, 20, more preferably 25, 30, 40, 47, or 50 consecutive nucleotides. In some embodiments, the chip may comprise an array of at least 2, 3, 4, 5, 6, 7, 8 or more of these polynucleotides of the invention. Solid supports and polynucleotides of the present invention attached to solid supports are further described in the section titled "Oligonucleotide probes and Primers".

5) Integrated Systems

Another technique, which may be used to analyze polymorphisms, includes multicomponent integrated systems, which miniaturize and compartmentalize processes such as PCR and capillary electrophoresis reactions in a single functional device. An example of such technique is disclosed in U.S. Pat. No. 5,589,136, which describes the integration of PCR amplification and capillary electrophoresis in chips.

Integrated systems can be envisaged mainly when microfluidic systems are used. These systems comprise a pattern of microchannels designed onto a glass, silicon, quartz, or plastic wafer included on a microchip. The movements of the samples are controlled by electric, electroosmotic or hydrostatic forces applied across different areas of the microchip. For genotyping biallelic markers, the microfluidic system may integrate nucleic acid amplification, microsequencing, capillary electrophoresis and a detection method such as laser-induced fluorescence detection.

Methods of Genetic Analysis Using the Biallelic Markers of the Present Invention Different methods are available for the genetic analysis of complex traits (see Lander and Schork, 1994). The search for disease-susceptibility genes is conducted using two main methods: the linkage approach in which evidence is sought for cosegregation between a locus and a putative trait locus using family studies, and the association approach in which evidence is sought for a statistically significant association between an allele and a trait or a trait causing allele (Khoury J. et al, 1993). In general, the biallelic markers of the present invention find use in any method known in the art to demonstrate a statistically significant correlation between a genotype and a phenotype. The biallelic markers may be used in parametric and non-parametric linkage analysis methods. Preferably, the biallelic markers of the present invention are used to identify genes associated with detectable traits using association studies, an approach which does not require the use of affected families and which permits the identification of genes associated with complex and sporadic traits.

The genetic analysis using the biallelic markers of the present invention may be conducted on any scale. The whole set of biallelic markers of the present invention or any subset of biallelic markers of the present invention may be used. In some embodiments a subset of biallelic markers corresponding to one or several candidate genes of the present invention may be used. Alternatively, a subset of biallelic markers of the present invention localised on a specific chromosome segment may be used. Further, any set of genetic markers including a biallelic marker of the present invention may be used. As mentioned above, it should be noted that the biallelic markers of the present invention may be included in any complete or partial genetic map of the human genome. These different uses are specifically contemplated in the present invention and claims.

Linkage Analysis

Linkage analysis is based upon establishing a correlation between the transmission of genetic markers and that of a specific trait throughout generations within a family. Thus, the aim of linkage analysis is to detect marker loci that show cosegregation with a trait of interest in pedigrees.

Parametric Methods

When data are available from successive generations there is the opportunity to study the degree of linkage between pairs of loci. Estimates of the recombination fraction enable loci to be ordered and placed onto a genetic map. With loci that are genetic markers, a genetic map can be established, and then the strength of linkage between markers and traits can be calculated and used to indicate the relative positions of markers and genes affecting those traits (Weir, B. S., 1996). The classical method for linkage analysis is the logarithm of odds (lod) score method (see Morton N. E., 1955; Ott J, 1991). Calculation of lod scores requires specification of the mode of inheritance for the disease (parametric method). Generally, the length of the candidate region identified using linkage analysis is between 2 and 20 Mb. Once a candidate region is identified as described above, analysis of recombinant individuals using additional markers allows further delineation of the candidate region. Linkage analysis studies have generally relied on the use of a maximum of 5,000 microsatellite markers, thus limiting the maximum theoretical attainable resolution of linkage analysis to about 600 kb on average.

Linkage analysis has been successfully applied to map simple genetic traits that show clear Mendelian inheritance patterns and which have a high penetrance (i.e., the ratio between the number of trait positive carriers of allele a and the total number of a carriers in the population). However, parametric linkage analysis suffers from a variety of drawbacks. First, it is limited by its reliance on the choice of a genetic model suitable for each studied trait. Furthermore, as already mentioned, the resolution attainable using linkage analysis is limited, and complementary studies are required to refine the analysis of the typical 2 Mb to 20 Mb regions initially identified through linkage analysis. In addition, parametric linkage analysis approaches have proven difficult when applied to complex genetic traits, such as those due to the combined action of multiple genes and/or environmental factors. It is very difficult to model these factors adequately in a lod score analysis. In such cases, too large an effort and cost are needed to recruit the adequate number of affected families required for applying linkage analysis to these situations, as recently discussed by Risch, N. and Merikangas, K. (1996).

Non-parametric Methods

The advantage of the so-called non-parametric methods for linkage analysis is that they do not require specification of the mode of inheritance for the disease, they tend to be more useful for the analysis of complex traits. In non-parametric methods, one tries to prove that the inheritance pattern of a chromosomal region is not consistent with random Mendelian segregation by showing that affected relatives inherit identical copies of the region more often than expected by chance. Affected relatives should show excess "allele sharing" even in the presence of incomplete penetrance and polygenic inheritance. In non-parametric linkage analysis the degree of agreement at a marker locus in two individuals can be measured either by the number of alleles identical by state (IBS) or by the number of alleles identical by descent (IBD). Affected sib pair analysis is a well-known special case and is the simplest form of these methods.

The biallelic markers of the present invention may be used in both parametric and non-parametric linkage analysis. Preferably biallelic markers may be used in non-parametric methods which allow the mapping of genes involved in complex traits. The biallelic markers of the present invention may be used in both IBD- and EBS-methods to map genes affecting a complex trait. In such studies, taking advantage of the high density of biallelic markers, several adjacent biallelic marker loci may be pooled to achieve the efficiency attained by multi-allelic markers (Zhao et al., 1998).

However, both parametric and non-parametric linkage analysis methods analyse affected relatives, they tend to be of limited value in the genetic analysis of drug responses or in the analysis of side effects to treatments. This type of analysis is impractical in such cases due to the lack of availability of familial cases. In fact, the likelihood of having more than one individual in a family being exposed to the same drug at the same time is extremely low.

Population Association Studies

The present invention comprises methods for identifying one or several genes among a set of candidate genes that are associated with a detectable trait using the biallelic markers of the present invention. In one embodiment the present invention comprises methods to detect an association between a biallelic marker allele or a biallelic marker haplotype and a trait. Further, the invention comprises methods to identify a trait causing allele in linkage disequilibrium with any biallelic marker allele of the present invention.

As described above, alternative approaches can be employed to perform association studies: genome-wide association studies, candidate region association studies and candidate gene association studies. The candidate region analysis clearly provides a short-cut approach to the identification of genes and gene polymorphisms related to a particular trait when some information concerning the biology of the trait is available. Further, the biallelic markers of the present invention may be incorporated in any map of genetic markers of the human genome in order to perform genome-wide association studies. Methods to generate a high-density map of biallelic markers has been described in U.S. Provisional Patent application serial No. 60/082,614. The biallelic markers of the present invention may further be incorporated in any map of a specific candidate region of the genome (a specific chromosome or a specific chromosomal segment for example).

As mentioned above, association studies may be conducted within the general population and are not limited to studies performed on related individuals in affected families. Association studies are extremely valuable as they permit the analysis of sporadic or multifactor traits. Moreover, association studies represent a powerful method for fine-scale mapping enabling much finer mapping of trait causing alleles than linkage studies. Studies based on pedigrees often only narrow the location of the trait causing allele. Association studies using the biallelic markers of the present invention can therefore be used to refine the location of a trait causing allele in a candidate region identified by Linkage Analysis methods. Biallelic markers of the present invention can be used to identify the involved gene; such uses are specifically contemplated in the present invention and claims.

1) Determining the Frequency of a Biallelic Marker Allele or of a Biallelic Marker Haplotype in a Population Another embodiment of the present invention encompasses methods of estimating the frequency of a haplotype for a set of biallelic markers in a population, comprising the steps of: a) genotyping each individual in said population for at least one 13q31–q33-related biallelic marker, b) genotyping each individual in said population for a second biallelic marker by determining the identity of the nucleotides at said second biallelic marker for both copies of said second biallelic marker present in the genome; and c) applying a haplotype determination method to the identities of the nucleotides determined in steps a) and b) to obtain an estimate of said frequency. In addition, the methods of estimating the frequency of a haplotype of the invention encompass methods with any further limitation described in this disclosure, or those following, specified alone or in any combination: optionally said haplotype determination method is selected from the group consisting of asymmetric PCR amplification, double PCR amplification of specific alleles, the Clark method, or an expectation maximization algorithm; optionally, said second biallelic marker is a 13q31–q33-related biallelic marker in a sequence selected from the group consisting of SEQ ID Nos 1 to 17, 24, 25, 28, 74 and 79 to 132, and the complements thereof; optionally, said 13q31–q33-related biallelic marker may be selected individually or in any combination from the biallelic markers described in Tables 6b and 6c; optionally, the identity of the nucleotides at the biallelic markers in everyone of the sequences of SEQ ID Nos 1 to 17, 24, 25, 28, 74 and 79 to 132 is determined in steps a) and b).

Association Studies Explore the Relationships Among Frequencies for Sets of Alleles between Loci.

Determining the Frequency of an Allele in a Population

Allelic frequencies of the biallelic markers in a population can be determined using one of the methods described above under the heading "Methods for genotyping an individual for biallelic markers", or any genotyping procedure suitable for this intended purpose. Genotyping pooled samples or individual samples can determine the frequency of a biallelic marker allele in a population. One way to reduce the number of genotypings required is to use pooled samples. A major obstacle in using pooled samples is in terms of accuracy and reproducibility for determining accurate DNA concentrations in setting up the pools. Genotyping individual samples provides higher sensitivity, reproducibility and accuracy and; is the preferred method used in the present invention. Preferably, each individual is genotyped separately and simple gene counting is applied to determine the frequency of an allele of a biallelic marker or of a genotype in a given population.

Determining the Frequency of a Haplotype in a Population

The gametic phase of haplotypes is unknown when diploid individuals are heterozygous at more than one locus. Using genealogical information in families gametic phase can sometimes be inferred (Perlin et al., 1994). When no genealogical information is available different strategies may be used. One possibility is that the multiple-site heterozygous diploids can be eliminated from the analysis, keeping only the homozygotes and the single-site heterozygote individuals, but this approach might lead to a possible bias in the sample composition and the underestimation of low-frequency haplotypes. Another possibility is that single chromosomes can be studied independently, for example, by asymmetric PCR amplification (see Newton et al., 1989; Wu et al., 1989) or by isolation of single chromosome by limit dilution followed by PCR amplification (see Ruano et al., 1990). Further, a sample may be haplotyped for sufficiently close biallelic markers by double PCR amplification of specific alleles (Sarkar, G. and Sommer S. S., 1991). These approaches are not entirely satisfying either because of their technical complexity, the additional cost they entail, their lack of generalisation at a large scale, or the possible biases they introduce. To overcome these difficulties, an algorithm to infer the phase of PCR-amplified DNA genotypes introduced by Clark A. G. (1990) may be used. Briefly, the principle is to start filling a preliminary list of haplotypes present in the sample by examining unambiguous individuals, that is, the complete homozygotes and the single-site heterozygotes. Then other individuals in the same sample are screened for the possible occurrence of previously recognised haplotypes. For each positive identification, the complementary haplotype is added to the list of recognised haplotypes, until the phase information for all individuals is either resolved or identified as unresolved. This method assigns a single haplotype to each multiheterozygous individual, whereas several haplotypes are possible when there are more than one heterozygous site. Alternatively, one can use methods estimating haplotype frequencies in a population without assigning haplotypes to each individual. Preferably, a method based on an expectation-maximization (EM) algorithm (Dempster et al., J. R. 1977) leading to maximum-likelihood estimates of haplotype frequencies under the assumption of Hardy-Weinberg proportions (random mating) is used (see Excoffier L. and Slatkin M., 1995). The EM algorithm is a generalised iterative maximum-likelihood approach to estimation that is useful when data are ambiguous and/or incomplete. The EM algorithm is used to resolve heterozygotes into haplotypes. Haplotype estimations are further described below under the heading "Statistical methods>>. Any other method known in the art to determine or to estimate the frequency of a haplotype in a population may also be used.

2) Linkage Disequilibrium Analysis

Linkage disequilibrium is the non-random association of alleles at two or more loci and represents a powerful tool for mapping genes involved in disease traits (see Ajioka R. S. et al., 1997). Biallelic markers, because they are densely spaced in the human genome and can be genotyped in more numerous numbers than other types of genetic markers (such as RFLP or VNTR markers), are particularly useful in genetic analysis based on linkage disequilibrium. The biallelic markers of the present invention may be used in any linkage disequilibrium analysis method known in the art.

Briefly, when a disease mutation is first introduced into a population (by a new mutation or the immigration of a mutation carrier), it necessarily resides on a single chromosome and thus on a single "background" or "ancestral" haplotype of linked markers. Consequently, there is complete disequilibrium between these markers and the disease mutation: one finds the disease mutation only in the presence of a specific set of marker alleles. Through subsequent generations recombinations occur between the disease mutation and these marker polymorphisms, and the disequilibrium gradually dissipates. The pace of this dissipation is a function of the recombination frequency, so the markers closest to the disease gene will manifest higher levels of disequilibrium than those that are further away. When not broken up by recombination, "ancestral" haplotypes and linkage disequilibrium between marker alleles at different loci can be tracked not only through pedigrees but also through populations. Linkage disequilibrium is usually seen as an association between one specific allele at one locus and another specific allele at a second locus.

The pattern or curve of disequilibrium between disease and marker loci is expected to exhibit a maximum that occurs at the disease locus. Consequently, the amount of linkage disequilibrium between a disease allele and closely linked genetic markers may yield valuable information regarding the location of the disease gene. For fine-scale mapping of a disease locus, it is useful to have some knowledge of the patterns of linkage disequilibrium that exist between markers in the studied region. As mentioned above the mapping resolution achieved through the analysis of linkage disequilibrium is much higher than that of linkage studies. The high density of biallelic markers combined with linkage disequilibrium analysis provides powerful tools for fine-scale mapping. Different methods to calculate linkage disequilibrium are described below under the heading "Statistical Methods".

3) Population-based Case-control Studies of Trait-marker Associations

As mentioned above, the occurrence of pairs of specific alleles at different loci on the same chromosome is not random and the deviation from random is called linkage disequilibrium. Association studies focus on population frequencies and rely on the phenomenon of linkage disequilibrium. If a specific allele in a given gene is directly involved in causing a particular trait, its frequency will be statistically increased in an affected (trait positive) population, when compared to the frequency in a trait negative population or in a random control population. As a consequence of the existence of linkage disequilibrium, the frequency of all other alleles present in the haplotype carrying the trait-causing allele will also be increased in trait positive individuals compared to trait negative individuals or random controls. Therefore, association between the trait and any allele (specifically a biallelic marker allele) in linkage disequilibrium with the trait-causing allele will suffice to suggest the presence of a trait-related gene in that particular region. Case-control populations can be genotyped for biallelic markers to identify associations that narrowly locate a trait causing allele. As any marker in linkage disequilibrium with one given marker associated with a trait will be associated with the trait. Linkage disequilibrium allows the relative frequencies in case-control populations of a limited number of genetic polymorphisms (specifically biallelic markers) to be analysed as an alternative to screening all possible functional polymorphisms in order to find trait-causing alleles. Association studies compare the frequency of marker alleles in unrelated case-control populations, and represent powerful tools for the dissection of complex traits.

Case-control Populations (Inclusion Criteria)

Population-based association studies do not concern familial inheritance but compare the prevalence of a particular genetic marker, or a set of markers, in case-control populations. They are case-control studies based on comparison of unrelated case (affected or trait positive) individuals and unrelated control (unaffected or trait negative or random) individuals. Preferably the control group is composed of unaffected or trait negative individuals. Further, the control group is ethnically matched to the case population. Moreover, the control group is preferably matched to the case-population for the main known confusion factor for the trait under study (for example age-matched for an age-dependent trait). Ideally, individuals in the two samples are paired in such a way that they are expected to differ only in their disease status. In the following "trait positive population>>, "case population" and "affected population" are used interchangeably.

An important step in the dissection of complex traits using association studies is the choice of case-control populations (see Lander and Schork, 1994). A major step in the choice of case-control populations is the clinical definition of a given trait or phenotype. Any genetic trait may be analysed by the association method proposed here by carefully selecting the individuals to be included in the trait positive and trait negative phenotypic groups. Four criteria are often useful: clinical phenotype, age at onset, family history and severity. The selection procedure for continuous or quantitative traits (such as blood pressure for example) involves selecting individuals at opposite ends of the phenotype distribution of the trait under study, so as to include in these trait positive and trait negative populations individuals with non-overlapping phenotypes. Preferably, case-control populations comprise phenotypically homogeneous populations. Trait positive and trait negative populations comprise phenotypically uniform populations of individuals representing each between 1 and 98%, preferably between 1 and 80%, more preferably between 1 and 50%, and more preferably between 1 and 30%, most preferably between 1 and 20% of the total population under study, and selected among individuals exhibiting non-overlapping phenotypes. The clearer-the difference between the two trait phenotypes, the greater the probability of detecting an association with biallelic markers. The selection of those drastically different but relatively uniform phenotypes enables efficient comparisons in association studies and the possible detection of marked differences at the genetic level, provided that the sample sizes of the populations under study are significant enough.

In preferred embodiments, a first group of between 50 and 300 trait positive individuals, preferably about 100 individuals, are recruited according to their phenotypes. A similar number of trait negative individuals are included in such studies.

In the present invention, typical examples of inclusion criteria include affection by schizophrenia.

Association Analysis

The general strategy to perform association studies using biallelic markers derived from a region carrying a candidate gene is to scan two groups of individuals (case-control populations) in order to measure and statistically compare the allele frequencies of the biallelic markers of the present invention in both groups.

If a statistically significant association with a trait is identified for at least one or more of the analysed biallelic markers, one can assume that: either the associated allele is directly responsible for causing the trait (the associated allele is the trait causing allele), or more likely the associated allele is in linkage disequilibrium with the trait causing allele. The specific characteristics of the associated allele with respect to the gene function usually gives further insight into the relationship between the associated allele and the trait (causal or in linkage disequilibrium). If the evidence indicates that the associated allele within the gene is most probably not the trait causing allele but is in linkage disequilibrium with the real trait causing allele, then the trait causing allele can be found by sequencing the vicinity of the associated marker.

Another embodiment of the present invention encompasses methods of detecting an association between a haplotype and a phenotype, comprising the steps of: a) estimating the frequency of at least one haplotype in a trait positive population according to a method of estimating the frequency of a haplotype of the invention; b) estimating the frequency of said haplotype in a control population according to the method of estimating the frequency of a haplotype of the invention; and c) determining whether a statistically significant association exists between said haplotype and said phenotype. In addition, the methods of detecting an association between a haplotype and a phenotype of the invention encompass methods with any further limitation described in this disclosure, or those following, specified alone or in any combination: Optionally, said 13q31–q33-related biallelic marker may be in a sequence selected individually or in any combination from the group consisting of SEQ ID Nos 1 to 17, 24, 25, 28, 74 and 79 to 132, and the complements thereof; optionally, said 13q31–q33-related biallelic marker may be selected individually or in any combination from the biallelic markers described in Tables 6b and 6c; optionally, said control population may be a trait negative population, or a random population; optionally, said phenotype is a disease involving schizophrenia, a response to an agent acting on schizophrenia, or a side effects to an agent acting on schizophrenia.

Haplotype Analysis

As described above, when a chromosome carrying a disease allele first appears in a population as a result of either mutation or migration, the mutant allele necessarily resides on a chromosome having a set of linked markers: the ancestral haplotype. This haplotype can be tracked through populations and its statistical association with a given trait can be analysed. Complementing single point (allelic) association studies with multi-point association studies also called haplotype studies increases the statistical power of association studies. Thus, a haplotype association study allows one to define the frequency and the type of the ancestral carrier haplotype. A haplotype analysis is important in that it increases the statistical power of an analysis involving individual markers.

In a first stage of a haplotype frequency analysis, the frequency of the possible haplotypes based on various combinations of the identified biallelic markers of the invention is determined. The haplotype frequency is then compared for distinct populations of trait positive and control individuals. The number of trait positive individuals, which should be, subjected to this analysis to obtain statistically significant results usually ranges between 30 and 300, with a preferred number of individuals ranging between 50 and 150. The same considerations apply to the number of unaffected individuals (or random control) used in the study. The results of this first analysis provide haplotype frequencies in case-control populations, for each evaluated haplotype frequency a p-value and an odd ratio are calculated. If a statistically significant association is found the relative risk for an individual carrying the given haplotype of being affected with the trait under study can be approximated.

Interaction Analysis

The biallelic markers of the present invention may also be used to identify patterns of biallelic markers associated with detectable traits resulting from polygenic interactions. The analysis of genetic interaction between alleles at unlinked loci requires individual genotyping using the techniques described herein. The analysis of allelic interaction among a selected set of biallelic markers with appropriate level of statistical significance can be considered as a haplotype analysis. Interaction analysis comprises stratifying the case-control populations with respect to a given haplotype for the first loci and performing a haplotype analysis with the second loci with each subpopulation.

Statistical methods used in association studies are further described herein.

4) Testing for Linkage in the Presence of Association

The biallelic markers of the present invention may further be used in TDT (transmission/disequilibrium test). TDT tests for both linkage and association and is not affected by population stratification. TDT requires data for affected individuals and their parents or data from unaffected sibs instead of from parents (see Spielmann S. et al., 1993; Schaid D. J. et al., 1996, Spielmann S. and Ewens W. J, 1998). Such combined tests generally reduce the false positive errors produced by separate analyses.

Statistical Methods

In general, any method known in the art to test whether a trait and a genotype show a statistically significant correlation may be used.

1) Methods in Linkage Analysis

Statistical methods and computer programs useful for linkage analysis are well-known to those skilled in the art (see Terwilliger J. D. and Ott J., 1994; Ott J., 1991).

2) Methods to Estimate Haplotype Frequencies in a Population

As described above, when genotypes are scored, it is often not possible to distinguish heterozygotes so that haplotype frequencies cannot be easily inferred. When the gametic phase is not known, haplotype frequencies can be estimated from the multilocus genotypic data. Any method known to person skilled in the art can be used to estimate haplotype frequencies (see Lange K., 1997; Weir, B. S., 1996) Preferably, maximum-likelihood haplotype frequencies are computed using an Expectation-Maximization (EM) algorithm (see Dempster et al., 1977; Excoffier L. and Slatkin M., 1995). This procedure is an iterative process aiming at obtaining maximum-likelihood estimates of haplotype frequencies from multi-locus genotype data when the gametic phase is unknown. Haplotype estimations are usually performed by applying the EM algorithm using for example the EM-HAPLO program (Hawley M. E. et al., 1994) or the Arlequin program (Schneider et al., 1997). The EM algorithm is a generalised iterative maximum likelihood approach to estimation and is briefly described below.

In the following part of this text, phenotypes will refer to multi-locus genotypes with unknown phase. Genotypes will refer to known-phase multi-locus genotypes. Suppose a sample of N unrelated individuals typed for K markers. The data observed are the unknown-phase K-locus phenotypes that can categorised in F different phenotypes. Suppose that we have H underlying possible haplotypes (in case of K biallelic markers, $H=2^K$).

For phenotype j, suppose that $c_j$ genotypes are possible. We thus have the following equation $$P_j = \sum_{i=1}^{c_j} pr(genotype_i) = \sum_{i=1}^{c_j} pr(h_k, h_l) \quad \text{Equation 1}$$

where Pj is the probability of the phenotype j, $h_k$ and $h_l$ are the two haplotypes constituent the genotype i. Under the Hardy-Weinberg equilibrium, $pr(h_k h_l)$ becomes:

$$pr(h_k, h_l) = pr(h_k)^2 \text{ if } h_k = h_l, pr(h_k, h_l) = 2pr(h_k).pr(h_l) \text{ if } h_k \neq h_l. \quad \text{Equation 2}$$

The successive steps of the E-M algorithm can be described as follows:

Starting with initial values of the of haplotypes frequencies, noted $p_1^{(0)}, p_2^{(0)}, \ldots p_H^{(0)}$, these initial values serve to estimate the genotype frequencies (Expectation step) and then estimate another set of haplotype frequencies (Maximisation step), noted $p_1^{(1)}, p_2^{(1)}, \ldots p_H^{(1)}$, these two steps are iterated until changes in the sets of haplotypes frequency are very small.

A stop criterion can be that the maximum difference between haplotype frequencies between two iterations is less than $10^{-7}$. These values can be adjusted according to the desired precision of estimations. In details, at a given iteration s, the Expectation step comprises calculating the genotypes frequencies by the following equation:

$$pr(genotype_i)^{(s)} = pr(phenotype_j) \cdot \quad \text{Equation 3}$$

$$pr(genotype_i \mid phenotype_j)^{(s)}$$

$$= \frac{n_j}{N} \cdot \frac{pr(h_k, h_l)^{(s)}}{P_j^{(s)}}$$

where genotype i occurs in phenotype j, and where $h_k$ and $h_l$ constitute genotype i. Each probability is derived according to eq.1, and eq.2 described above.

Then the Maximisation step simply estimates another set of haplotype frequencies given the genotypes frequencies. This approach is also known as gene-counting method (Smith, 1957).

$$p_t^{(s+1)} = \frac{1}{2} \sum_{j=1}^{F} \sum_{i=1}^{c_j} \delta_{it} \cdot pr(genotype_i)^{(s)} \quad \text{Equation 4}$$

Where $\delta_{it}$ is an indicator variable which count the number of time haplotype t in genotype i. It takes the values of 0, 1 or 2.

To ensure that the estimation finally obtained is the maximum-likelihood estimation several values of departures are required. The estimations obtained are compared and if they are different the estimations leading to the best likelihood are kept.

3) Methods to Calculate Linkage Disequilibrium between Markers

A number of methods can be used to calculate linkage disequilibrium between any two genetic positions, in practice linkage disequilibrium is measured by applying a statistical association test to haplotype data taken from a population. Linkage disequilibrium between any pair of biallelic markers comprising at least one of the biallelic markers of the present invention ($M_i$, $M_j$) having alleles ($a_i/b_i$) at marker $M_i$ and alleles ($a_j/b_j$) at marker $M_j$ can be calculated for every allele combination ($a_i,a_j$; $a_i,b_j$; $b_i,a_j$ and $b_i,b_j$), according to the Piazza formula:

$$\Delta_{aiaj} = \sqrt{\theta 4} - \sqrt{(\theta 4 + \theta 3)(\theta 4 + \theta 2)},$$

where:

$\theta 4 = ---$ =frequency of genotypes not having allele $a_i$ at $m_i$ and not having allele $a_j$ at $M_j$ $\theta 3 = -+$ =frequency of genotypes not having allele $a_i$ at $m_i$ and having allele $a_j$ at $M_j$ $\theta 2 = +-$ =frequency of genotypes having allele $a_i$ at $m_i$ and not having allele $a_j$ at $M_j$ Linkage disequilibrium (LD) between pairs of biallelic markers ($M_i$, $M_j$) can also be calculated for every allele combination (ai,aj; ai,bj; bi,$a_j$ and $b_i$,$b_j$), according to the maximum-likelihood estimate (MLE) for delta (the composite genotypic disequilibrium coefficient), as described by Weir (Weir B. S., 1996). The MLE for the composite linkage disequilibrium is:

$$D_{aiaj} = (2n_1 + n_2 + n_3 + n_4/2)/N - 2(pr(a_i).pr(a_j))$$

where $n_1 = \Sigma$ phenotype ($a_i/a_i$, $a_j/a_j$), $n_2 = \Sigma$ phenotype ($a_i/a_i a_j/b_j$), $n_3 = \Sigma$ phenotype ($a_i/b_i$, $a_j/a_j$), n4=$\Sigma$ phenotype ($a_i/b_i,a_j/b_j$) and N is the number of individuals in the sample. This formula allows linkage disequilibrium between alleles to be estimated when only genotype, and not haplotype, data are available.

Another means of calculating the linkage disequilibrium between markers is as follows. For a couple of biallelic markers, $M_i$ ($a_i/b_i$) and $M_j$ ($a_j/b_j$), fitting the Hardy-Weinberg equilibrium, one can estimate the four possible haplotype frequencies in a given population according to the approach described above.

The estimation of gametic disequilibrium between ai and aj is simply:

$$D_{aiaj} = pr(\text{haplotype}(a_i,a_j)) - pr(a_i).pr(a_j).$$

Where $pr(a_i)$ is the probability of allele $a_i$ and $pr(a_i)$ is the probability of allele $a_j$ and where pr(haplotype ($a_i$, $a_j$)) is estimated as in Equation 3 above.

For a couple of biallelic marker only one measure of disequilibrium is necessary to describe the association between $M_i$ and $M_j$.

Then a normalised value of the above is calculated as follows:

$$D'_{aiaj} = D_{aiaj}/\max(-pr(a_i).pr(a_j), -pr(b_i).pr(b_j)) \text{ with } D_{aiaj} < 0$$

$$D'_{aiaj} = D_{aiaj}/\max(pr(b_i).pr(a_j), pr(a_i).pr(b_j)) \text{ with } D_{aiaj} > 0$$

The skilled person will readily appreciate that other LD calculation methods can be used without undue experimentation.

Linkage disequilibrium among a set of biallelic markers having an adequate heterozygosity rate can be determined by genotyping between 50 and 1000 unrelated individuals, preferably between 75 and 200, more preferably around 100.

4) Testing for Association

Methods for determining the statistical significance of a correlation between a phenotype and a genotype, in this case an allele at a biallelic marker or a haplotype made up of such alleles, may be determined by any statistical test known in the art and with any accepted threshold of statistical significance being required. The application of particular methods and thresholds of significance are well with in the skill of the ordinary practitioner of the art.

Testing for association is performed by determining the frequency of a biallelic marker allele in case and control populations and comparing these frequencies with a statistical test to determine if their is a statistically significant difference in frequency which would indicate a correlation between the trait and the biallelic marker allele under study. Similarly, a haplotype analysis is performed by estimating the frequencies of all possible haplotypes for a given set of biallelic markers in case and control populations, and comparing these frequencies with a statistical test to determine if their is a statistically significant correlation between the haplotype and the phenotype (trait) under study. Any statistical tool useful to test for a statistically significant association between a genotype and a phenotype may be used. Preferably the statistical test employed is a chi-square test with one degree of freedom. A P-value is calculated (the P-value is the probability that a statistic as large or larger than the observed one would occur by chance).

Statistical Significance

In preferred embodiments, significance for diagnosis purposes, either as a positive basis for further diagnostic tests or as a preliminary starting point for early preventive therapy, the p value related to a biallelic marker association is preferably about $1 \times 10^{-2}$ or less, more preferably about $1 \times 10^{-4}$ or less, for a single biallelic marker analysis and about $1 \times 10^{-3}$ or less, still more preferably $1 \times 10^{-6}$ or less and most preferably of about $1 \times 10^{-8}$ or less, for a haplotype analysis involving several markers. These values are believed to be applicable to any association studies involving single or multiple marker combinations.

The skilled person can use the range of values set forth above as a starting point in order to carry out association studies with biallelic markers of the present invention. In doing so, significant associations between the biallelic markers of the present invention and diseases involving schizophrenia can be revealed and used for diagnosis and drug screening purposes.

Phenotypic Permutation

In order to confirm the statistical significance of the first stage haplotype analysis described above, it might be suitable to perform further analyses in which genotyping data from case-control individuals are pooled and randomised with respect to the trait phenotype. Each individual genotyping data is randomly allocated to two groups, which contain the same number of individuals as the case-control populations used to compile the data obtained in the first stage. A second stage haplotype analysis is preferably run on these artificial groups, preferably for the markers included in the haplotype of the first stage analysis showing the highest relative risk coefficient. This experiment is reiterated preferably at least between 100 and 10000 times. The repeated iterations allow the determination of the percentage of obtained haplotypes with a significant p-value level.

Assessment of Statistical Association

To address the problem of false positives similar analysis may be performed with the same case-control populations in random genomic regions. Results in random regions and the candidate region are compared as described in U.S. Provisional Patent Application entitled "Methods, software and apparati for identifying genomic regions harbouring a gene associated with a detectable trait".

5) Evaluation of Risk Factors

The association between a risk factor (in genetic epidemiology the risk factor is the presence or the absence of a certain allele or haplotype at marker loci) and a disease is measured by the odds ratio (OR) and by the relative risk (RR). If $P(R^+)$ is the probability of developing the disease for individuals with R and $P(R^-)$ is the probability for individuals without the risk factor, then the relative risk is simply the ratio of the two probabilities, that is:

$$RR = P(R^+)/P(R^-)$$

In case-control studies, direct measures of the relative risk cannot be obtained because of the sampling design. However, the odds ratio allows a good approximation of the relative risk for low-incidence diseases and can be calculated:

$$OR = \left[\frac{F^+}{1-F^+}\right] / \left[\frac{F^-}{(1-F^-)}\right]$$

$F^+$ is the frequency of the exposure to the risk factor in cases and $F^-$ is the frequency of the exposure to the risk factor in controls. $F^+$ and $F^-$ are calculated using the allelic or haplotype frequencies of the study and further depend on the underlying genetic model (dominant, recessive, additive . . .).

One can further estimate the attributable risk (AR) which describes the proportion of individuals in a population exhibiting a trait due to a given risk factor. This measure is important in quantitating the role of a specific factor in disease etiology and in terms of the public health impact of a risk factor. The public health relevance of this measure lies in estimating the proportion of cases of disease in the population that could be prevented if the exposure of interest were absent. AR is determined as follows:

$$AR = P_E(RR-1)/(P_E(RR-1)+1)$$

AR is the risk attributable to a biallelic marker allele or a biallelic marker haplotype. $P_E$ is the frequency of exposure to an allele or a haplotype within the population at large; and RR is the relative risk which, is approximated with the odds ratio when the trait under study has a relatively low incidence in the general population.

AR is the risk attributable to a biallelic marker allele or a biallelic marker haplotype. $P_E$ is the frequency of exposure to an allele or a haplotype within the population at large; and RR is the relative risk which, is approximated with the odds ratio when the trait under study has a relatively low incidence in the general population.

Association of Biallelic Markers of the Invention with Schizophrenia

In the context of the present invention, an association between chromosome 13q31–q33-related biallelic markers and schizophrenia and bipolar disorder were established. Several association studies using different populations and screening samples thereof, and with different sets of biallelic markers distributed on the chromosome 13q31–q33 region were carried out. Further details concerning these association studies and the results are provided herein in Examples 5a to 5e.

This information is extremely valuable. The knowledge of a potential genetic predisposition to schizophrenia, even if this predisposition is not absolute, might contribute in a very significant manner to treatment efficacy of schizophrenia and to the development of new therapeutic and diagnostic tools.

Identification of Biallelic Markers in Linkage Disequilibrium with the Biallelic Markers of the Invention Once a first biallelic marker has been identified in a genomic region of interest, the practitioner of ordinary skill in the art, using the teachings of the present invention, can easily identify additional biallelic markers in linkage disequilibrium with this first marker. As mentioned before, any marker in linkage disequilibrium with a first marker associated with a trait will be associated with the trait. Therefore, once an association has been demonstrated between a given biallelic marker and a trait, the discovery of additional biallelic markers associated with this trait is of great interest in order to increase the density of biallelic markers in this particular region. The causal gene or mutation will be found in the vicinity of the marker or set of markers showing the highest correlation with the trait.

Identification of additional markers in linkage disequilibrium with a given marker involves: (a) amplifying a genomic fragment comprising a first biallelic marker from a plurality of individuals; (b) identifying of second biallelic markers in the genomic region harboring said first biallelic marker; (c) conducting a linkage disequilibrium analysis between said first biallelic marker and second biallelic markers; and (d) selecting said second biallelic markers as being in linkage disequilibrium with said first marker. Subcombinations comprising steps (b) and (c) are also contemplated.

Methods to identify biallelic markers and to conduct linkage disequilibrium analysis are described herein and can be carried out by the skilled person without undue experimentation. The present invention then also concerns biallelic markers and other polymorphisms which are in linkage disequilibrium with the specific biallelic markers of the invention and which are expected to present similar characteristics in terms of their respective association with a given trait. In a preferred embodiment, the invnetion concerns biallelic markers which are in linkage disequilibrium with the specific biallelic markers.

Identification Of Functional Mutations

Once a positive association is confirmed with a biallelic marker of the present invention, the associated candidate gene sequence can be scanned for mutations by comparing the sequences of a selected number of trait positive and trait negative individuals. In a preferred embodiment, functional regions such as exons and splice sites, promoters and other regulatory regions of the gene are scanned for mutations. Preferably, trait positive individuals carry the haplotype shown to be associated with the trait and trait negative individuals do not carry the haplotype or allele associated with the trait. The mutation detection procedure is essentially similar to that used for biallelic site identification.

The method used to detect such mutations generally comprises the following steps: (a) amplification of a region of the candidate DNA sequence comprising a biallelic marker or a group of biallelic markers associated with the trait from DNA samples of trait positive patients and trait negative controls; (b) sequencing of the amplified region; (c) comparison of DNA sequences from trait-positive patients and trait-negative controls; and (d) determination of mutations specific to trait-positive patients. Subcombinations which comprise steps (b) and (c) are specifically contemplated.

It is preferred that candidate polymorphisms be then verified by screening a larger population of cases and controls by means of any genotyping procedure such as those described herein, preferably using a microsequencing technique in an individual test format. Polymorphisms are considered as candidate mutations when present in cases and controls at frequencies compatible with the expected association results.

Candidate polymorphisms and mutations of the g35030 nucleic acid sequences suspected of being involved in a predisposition to schizophrenia can be confirmed by screening a larger population of affected and unaffected individuals using any of the genotyping procedures described herein. Preferably the microsequencing technique is used. Such polymorphisms are considered as candidate "trait-causing" mutations when they exhibit a statistically significant correlation with the detectable phenotype.

Biallelic Markers of the Invention in Methods of Genetic Diagnostics

The biallelic markers and other polymorphisms of the present invention can also be used to develop diagnostics tests capable of identifying individuals who express a detectable trait as the result of a specific genotype or individuals whose genotype places them at risk of developing a detectable trait at a subsequent time. The trait analyzed using the present diagnostics may be any detectable trait, including predisposition to schizophrenia, age of onset of detectable symptoms, a beneficial response to or side effects related to treatment against schizophrenia. Such a diganosis can be useful in the monitoring, prognosis and/or prophylactic or curative therapy for schizophrenia.

The diagnostic techniques of the present invention may employ a variety of methodologies to determine whether a test subject has a genotype associated with an increased risk of developing a detectable trait or whether the individual suffers from a detectable trait as a result of a particular mutation, including methods which enable the analysis of individual chromosomes for haplotyping, such as family studies, single sperm DNA analysis or somatic hybrids.

The diagnostic techniques concern the detection of specific alleles present within the human chromosome 13q31–q33 region and optionally within a g35030 nucleic acid sequence. More particularly, the invention concerns the detection of a nucleic acid comprising at least one of the nucleotide sequences of SEQ ID Nos. 1 to 17, 24, 25, 28, 74 and 79 to 132 or a fragment thereof or a complementary sequence thereto including the polymorphic base.

These methods involve obtaining a nucleic acid sample from the individual and, determining, whether the nucleic acid sample contains at least one allele or at least one biallelic marker haplotype, indicative of a risk of developing the trait or indicative that the individual expresses the trait as a result of possessing a particular the human chromosome 13q31–q33- or g35030-related polymorphism or mutation (trait-causing allele).

Preferably, in such diagnostic methods, a nucleic acid sample is obtained from the individual and this sample is genotyped using methods described above in "Methods Of Genotyping DNA Samples For Biallelic markers." The diagnostics may be based on a single biallelic marker or a on group of biallelic markers.

In each of these methods, a nucleic acid sample is obtained from the test subject and the biallelic marker pattern of one or more of the biallelic markers of the invention is determined.

In one embodiment, a PCR amplification is conducted on the nucleic acid sample to amplify regions in which polymorphisms associated with a detectable phenotype have been identified. The amplification products are sequenced to determine whether the individual possesses one or more human chromosome 13q31–q33 region- or g35030-related polymorphisms associated with a detectable phenotype. The primers used to generate amplification products may comprise the primers listed in Table 4. Alternatively, the nucleic acid sample is subjected to microsequencing reactions as described above to determine whether the individual possesses one or more human chromosome 13q31–q33 region-related polymorphisms associated with a detectable phenotype resulting from a mutation or a polymorphism in the human chromosome 13q31–q33 region or g35030-related biallelic marker. The primers used in the microsequencing reactions may include the primers listed in 6. In another embodiment, the nucleic acid sample is contacted with one or more allele specific oligonucleotide probes which, specifically hybridize to one or more human chromosome 13q31–q33 region or g35030-related alleles associated with a detectable phenotype. The probes used in the hybridization assay may include the probes listed in Table 5. In another embodiment, the nucleic acid sample is contacted with a second oligonucleotide capable of producing an amplification product when used with the allele specific oligonucleotide in an amplification reaction. The presence of an amplification product in the amplification reaction indicates that the individual possesses one or more human chromosome 13q31–q33 region or g35030-related alleles associated with a detectable phenotype.

In a preferred embodiment the identity of the nucleotide present at, at least one, biallelic marker selected from the group consisting of A13 to A18, A20 to A46, A49 to A52, A55, A57, A59 to A63, A72 to A73, A76 and A123 and the complements thereof, is determined and the detectable trait is schizophrenia. Diagnostic kits comprise any of the polynucleotides of the present invention.

These diagnostic methods are extremely valuable as they can, in certain circumstances, be used to initiate preventive treatments or to allow an individual carrying a significant haplotype to foresee warning signs such as minor symptoms.

Diagnostics, which analyze and predict response to a drug or side effects to a drug, may be used to determine whether an individual should be treated with a particular drug. For example, if the diagnostic indicates a likelihood that an individual will respond positively to treatment with a particular drug, the drug may be administered to the individual. Conversely, if the diagnostic indicates that an individual is likely to respond negatively to treatment with a particular drug, an alternative course of treatment may be prescribed. A negative response may be defined as either the absence of an efficacious response or the presence of toxic side effects.

Clinical drug trials represent another application for the markers of the present invention. One or more markers indicative of response to an agent acting against schizophrenia or to side effects to an agent acting against schizophrenia may be identified using the methods described above. Thereafter, potential participants in clinical trials of such an agent may be screened to identify those individuals most likely to respond favorably to the drug and exclude those likely to experience side effects. In that way, the effectiveness of drug treatment may be measured in individuals who respond positively to the drug, without lowering the measurement as a result of the inclusion of individuals who are unlikely to respond positively in the study and without risking undesirable safety problems.

Prevention, Diagnosis and Treatment of Psychiatric Disease

An aspect of the present invention relates to the preparation of a medicament for the treatment of psychiatric disease, in particular schizophrenia and bipolar disorder. The present invention embodies medicaments acting on g35030.

In preferred embodiments, medicaments of the invention act on g35030, either directly or indirectly, by acting on the g35030 pathways. For example, the medicaments may modulate, and more preferably decrease the level of g35030 activity which occurs in a cell or particular tissue, or increase or descrease the activity of the g35030 protein. In certain embodiments, the invention thus comprises use of a compound capable of increasing or decreasing g35030 expression or g35030 protein activity in the preparation or manufacture of a medicament. Preferably, said compound is used for the treatment of a psychiatric disease, preferably for the treatment of schizophrenia or bipolar disorder. Preferably, said compound acts directly by binding to g35030 of a g35030 receptor.

Such medicaments may also increase or decrease the activity of a compound analogous to g35030, a compound comprising an amino acid sequence having at least 25% homology to a sequence selected from the group consisting of SEQ ID NOs. 18 to 23, a compound comprising an amino acid sequence having at least 50% homology to a sequence selected from the group consisting of SEQ ID NOs. 18 to 23, and a compound comprising an amino acid sequence having at least 80% homology to a sequence selected from the group consisting of SEQ ID NOs. 18 to 23.

Medicaments which increase or descrease the activity of these compounds in an individual may be used to ameliorate or prevent symptoms in individuals suffering from or predisposed to a psychiatric disease, as discussed above in the section entitled "indications".

Alternatively, g35030 activity may be increased or decreased by the expression of the genes encoding the identified g35030-modulating compounds using gene therapy. Examples of vectors and promoters suitable for use in gene therapy are described above. G35030 activity may also be increased or decreased by preparing an antibody which binds to a g35030 peptide, a g35030 receptor or a protein related thereto, as well as fragments of these proteins. Such antibodies may modulate the interaction between g35030 and a g35030 receptor or a protein related thereto. Antibodies and methods of obtaining them are further described herein.

As described above, the present invention provides cellular assays for identifying compounds for the treatment of psychiatric disease. The assays are based on detection of g35030 expression, measurement of g35030 protein activity, or based on the determination of other suitable schizophrenia, bipolar disorder or related psychiatric disease endpoints. Compounds for the treatment of psychiatric disease include derivative proteins or peptides which are capable of inhibiting the activity of a wild type g35030 protein, which may be identified by determining their ability to bind a wild type g35030 protein. Compounds also include antibodies, and small molecules and drugs which may be obtained using a variety of synthetic approaches familiar to those skilled in the art, including combinatorial chemistry based techniques.

The invention further encompasses said methods for the prevention, treatment, and diagnosis of disease using any of the g35030 nucleic acids of proteins of the invention in analogous methods.

G35030 in Methods of Diagnosis or Detecting Predisposition

Individuals affected by or predisposed to schizophrenia and bipolar disorder may express abnormal levels of g35030. Individuals having increased or decreased g35030 activity in their plasma, body fluids, or body tissues may be at risk of devloping schizophrenia, bipolar disorder or a variety of potentially related psychiatric conditions. In one aspect of the present invention is a method for determining whether an individual is at risk of suffering from or is currently suffering from schizophrenia, bipolar disorder or other psychotic disorders, mood disorders, autism, substance dependence or alcoholism, mental retardation, or other psychiatric diseases including cognitive, anxiety, eating, impulse-control, and personality disorders, as defined with the Diagnosis and Statistical Manual of Mental Disorders fourth edition (DSM-IV) classification, comprising determining whether the individual has an abnormal level of g35030 activity in plasma, body fluids, or body tissues. The level of g35030 or analogous compounds in plasma, body fluids, or body tissues may be determined using a variety approaches. In particular, the level may be determined using ELISA, Western Blots, or protein electrophoresis.

Biallelic Markers of the Invention in Methods of Genetic Diagnostics

The biallelic markers and other polymorphisms of the present invention can also be used to develop diagnostics tests capable of identifying individuals who express a detectable trait as the result of a specific genotype or individuals whose genotype places them at risk of developing a detectable trait at a subsequent time. The trait analyzed using the present diagnostics may be used to diagnose any detectable trait, including predisposition to schizophrenia or bipolar disorder, age of onset of detectable symptoms, a beneficial response to or side effects related to treatment against schizophrenia or bipolar disorder. Such a diagnosis can be useful in the monitoring, prognosis and/or prophylactic or curative therapy for schizophrenia or bipolar disorder.

The diagnostic techniques of the present invention may employ a variety of methodologies to determine whether a test subject has a genotype associated with an increased risk of developing a detectable trait or whether the individual suffers from a detectable trait as a result of a particular mutation, including methods which enable the analysis of individual chromosomes for haplotyping, such as family studies, single sperm DNA analysis or somatic hybrids.

The diagnostic techniques concern the detection of specific alleles present within the human chromosome 13q31–q33 region, and optionally within a g35030 nucleic acid sequence. More particularly, the invention concerns the detection of a nucleic acid comprising at least one of the nucleotide sequences of SEQ ID Nos. 1 to 17, 24, 25, 28, 74 and 79 to 132 or a fragment thereof or a complementary sequence thereto including the polymorphic base.

These methods involve obtaining a nucleic acid sample from the individual and, determining, whether the nucleic acid sample contains at least one allele or at least one biallelic marker haplotype, indicative of a risk of developing the trait or indicative that the individual expresses the trait as a result of possessing a particular the human chromosome 13q31–q33 region-related polymorphism or mutation (trait-causing allele).

Preferably, in such diagnostic methods, a nucleic acid sample is obtained from the individual and this sample is genotyped using methods described above in "Methods Of Genotyping DNA Samples For Biallelic markers." The diagnostics may be based on a single biallelic marker or a on group of biallelic markers.

In each of these methods, a nucleic acid sample is obtained from the test subject and the biallelic marker pattern of one or more of a biallelic marker of the invention is determined.

In one embodiment, a PCR amplification is conducted on the nucleic acid sample to amplify regions in which polymorphisms associated with a detectable phenotype have been identified. The amplification products are sequenced to determine whether the individual possesses one or more human chromosome 13q31–q33 region, g35030-related polymorphisms associated with a detectable phenotype. The primers used to generate amplification products may comprise the primers listed in Table 4. Alternatively, the nucleic acid sample is subjected to microsequencing reactions as described above to determine whether the individual possesses one or more human chromosome 13q31–q33 region, g35030-related polymorphisms associated with a detectable phenotype resulting from a mutation or a polymorphism in the human chromosome 13q3 1–q33 region. The primers used in the microsequencing reactions may include the primers listed in Table 6. In another embodiment, the nucleic acid sample is contacted with one or more allele specific oligonucleotide probes which, specifically hybridize to one or more human chromosome 13q31–q33 region, g35030-related alleles associated with a detectable phenotype.

The probes used in the hybridization assay may include the probes listed in 6b. In another embodiment, the nucleic acid sample is contacted with a second oligonucleotide capable of producing an amplification product when used with the allele specific oligonucleotide in an amplification reaction. The presence of an amplification product in the amplification reaction indicates that the individual possesses one or more human chromosome 13q31–q33 region, g35030-related alleles associated with a detectable phenotype. In a preferred embodiment, the detectable trait is schizophrenia or bipolar disorder. Diagnostic kits comprise any of the polynucleotides of the present invention.

These diagnostic methods are extremely valuable as they can, in certain circumstances, be used to initiate preventive treatments or to allow an individual carrying a significant haplotype to foresee warning signs such as minor symptoms.

Diagnostics, which analyze and predict response to a drug or side effects to a drug, may be used to determine whether an individual should be treated with a particular drug. For example, if the diagnostic indicates a likelihood that an individual will respond positively to treatment with a particular drug, the drug may be administered to the individual. Conversely, if the diagnostic indicates that an individual is likely to respond negatively to treatment with a particular drug, an alternative course of treatment may be prescribed. A negative response may be defined as either the absence of an efficacious response or the presence of toxic side effects.

Clinical drug trials represent another application for the markers of the present invention. One or more markers indicative of response to an agent acting against schizophrenia or to side effects to an agent acting against schizophrenia may be identified using the methods described above. Thereafter, potential participants in clinical trials of such an agent may be screened to identify those individuals most likely to respond favorably to the drug and exclude those likely to experience side effects. In that way, the effectiveness of drug treatment may be measured in individuals who respond positively to the drug, without lowering the measurement as a result of the inclusion of individuals who are unlikely to respond positively in the study and without risking undesirable safety problems.

Prevention and Treatment of Disease Using Biallelic Markers

In large part because of the risk of suicide, the detection of susceptibility to schizophrenia, bipolar disorder as well as other psychiatric disease in individuals is very important. Consequently, the invention concerns a method for the treatment of schizophrenia or bipolar disorder, or a related disorder comprising the following steps:

selecting an individual whose DNA comprises alleles of a biallelic marker or of a group of biallelic markers of the human chromosome 13q31–q33 region, preferably g35030-related markers associated with schizophrenia or bipolar disorder;

following up said individual for the appearance (and optionally the development) of the symptoms related to schizophrenia or bipolar disorder; and administering a treatment acting against schizophrenia or bipolar disorder or against symptoms thereof to said individual at an appropriate stage of the disease.

Another embodiment of the present invention comprises a method for the treatment of schizophrenia or bipolar disorder comprising the following steps:

selecting an individual whose DNA comprises alleles of a biallelic marker or of a group of biallelic markers, of the human chromosome 13q31–q33 region, and more preferably g35030-related markers associated with schizophrenia or bipolar disorder;

administering a preventive treatment of schizophrenia or bipolar disorder to said individual.

In a further embodiment, the present invention concerns a method for the treatment of schizophrenia or bipolar disorder comprising the following steps:

selecting an individual whose DNA comprises alleles of a biallelic marker or of a group of biallelic markers of the human chromosome 13q31–q33, and more preferably g35030-related markers associated with schizophrenia or bipolar disorder;

administering a preventive treatment of schizophrenia or bipolar disorder to said individual;

following up said individual for the appearance and the development of schizophrenia or bipolar disorder symptoms; and optionally administering a treatment acting against schizophrenia or bipolar disorder or against symptoms thereof to said individual at the appropriate stage of the disease.

For use in the determination of the course of treatment of an individual disease, the present invention also concerns a method for the treatment of schizophrenia bipolar disorder comprising the following steps:

selecting an individual suffering from schizophrenia or bipolar disorder whose DNA comprises alleles of a biallelic marker or of a group of biallelic markers of the human chromosome 13q31–q33 region, and preferably g35030-related markers, associated with the gravity of schizophrenia or bipolar disorder or of the symptoms thereof; and administering a treatment acting against schizophrenia or bipolar disorder or symptoms thereof to said individual.

The invention also concerns a method for the treatment of schizophrenia or bipolar disorder in a selected population of individuals. The method comprises:

selecting an individual suffering from schizophrenia or bipolar disorder and whose DNA comprises alleles of a biallelic marker or of a group of biallelic markers of the human chromosome 13q31–q33 region, and more preferably g35030-related markers associated with a positive response to treatment with an effective amount of a medicament acting against schizophrenia or bipolar disorder or symptoms thereof, and/or whose DNA does not comprise alleles of a biallelic marker or of a group of biallelic markers of the human chromosome 13q31–q33 region, and more preferably g35030-related markers associated with a negative response to treatment with said medicament; and administering at suitable intervals an effective amount of said medicament to said selected individual.

In the context of the present invention, a "positive response" to a medicament can be defined as comprising a reduction of the symptoms related to the disease. In the context of the present invention, a "negative response" to a medicament can be defined as comprising either a lack of positive response to the medicament which does not lead to a symptom reduction or which leads to a side-effect observed following administration of the medicament.

The invention also relates to a method of determining whether a subject is likely to respond positively to treatment with a medicament. The method comprises identifying a first population of individuals who respond positively to said medicament and a second population of individuals who respond negatively to said medicament. One or more biallelic markers is identified in the first population which is associated with a positive response to said medicament or one or more biallelic markers is identified in the second population which is associated with a negative response to said medicament. The biallelic markers may be identified using the techniques described herein.

A DNA sample is then obtained from the subject to be tested. The DNA sample is analyzed to determine whether it comprises alleles of one or more biallelic markers associated with a positive response to treatment with the medicament and/or alleles of one or more biallelic markers associated with a negative response to treatment with the medicament.

In some embodiments, the medicament may be administered to the subject in a clinical trial if the DNA sample contains alleles of one or more biallelic markers associated with a positive response to treatment with the medicament and/or if the DNA sample lacks alleles of one or more biallelic markers associated with a negative response to treatment with the medicament. In preferred embodiments, the medicament is a drug acting against schizophrenia or bipolar disorder.

Using the method of the present invention, the evaluation of drug efficacy may be conducted in a population of individuals likely to respond favorably to the medicament.

Another aspect of the invention is a method of using a medicament comprising obtaining a DNA sample from a subject, determining whether the DNA sample contains alleles of one or more biallelic markers associated with a positive response to the medicament and/or whether the DNA sample contains alleles of one or more biallelic markers associated with a negative response to the medicament, and administering the medicament to the subject if the DNA sample contains alleles of one or more biallelic markers associated with a positive response to the medicament and/or if the DNA sample lacks alleles of one or more biallelic markers associated with a negative response to the medicament.

The invention also concerns a method for the clinical testing of a medicament, preferably a medicament acting against schizophrenia or or bipolar disorder or symptoms thereof. The method comprises the following steps:

administering a medicament, preferably a medicament susceptible of acting against schizophrenia or or bipolar disorder or symptoms thereof to a heterogeneous population of individuals, identifying a first population of individuals who respond positively to said medicament and a second population of individuals who respond negatively to said medicament, identifying biallelic markers in said first population which are associated with a positive response to said medicament, selecting individuals whose DNA comprises biallelic markers associated with a positive response to said medicament, and administering said medicament to said individuals.

In any of the methods for the prevention, diagnosis and treatment of schizophrenia and bipolar disorder, including methods of using a medicament, clinical testing of a medicament, determining whether a subject is likely to respond positively to treatment with a medicament, said biallelic marker may optionally comprise:

(a) a biallelic marker selected from the group consisting of g35030-related markers A13 to A65; (b) a biallelic marker selected from the group consisting of chromosome 13q31–q33-related-biallelic markers A13 to A18, A20 to A46, A49 to A52, A55, A57, A59 to A63, A72 to A73, A76 and A123 ; or (c) a biallelic marker selected from the group consisting of chromosome 13q31–q33-related-biallelic markers A13 to A18, A20 to A47, A49 to A52, A55, A57, A59 to A63. Furthermore, any of the embodiments of the invention may specifically exclude one or more of the biallelic markers selected from biallelic markers A1 to A127.

Such methods are deemed to be extremely useful to increase the benefit/risk ratio resulting from the administration of medicaments which may cause undesirable side effects and/or be inefficacious to a portion of the patient population to which it is normally administered.

Once an individual has been diagnosed as suffering from schizophrenia or bipolar disorder, selection tests are carried out to determine whether the DNA of this individual comprises alleles of a biallelic marker or of a group of biallelic markers associated with a positive response to treatment or with a negative response to treatment which may include either side effects or unresponsiveness.

The selection of the patient to be treated using the method of the present invention can be carried out through the detection methods described above. The individuals which are to be selected are preferably those whose DNA does not comprise alleles of a biallelic marker or of a group of biallelic markers associated with a negative response to treatment. The knowledge of an individual's genetic predisposition to unresponsiveness or side effects to particular medicaments allows the clinician to direct treatment toward appropriate drugs against schizophrenia or bipolar disorder or symptoms thereof.

Once the patient's genetic predispositions have been determined, the clinician can select appropriate treatment for which negative response, particularly side effects, has not been reported or has been reported only marginally for the patient.

The biallelic markers of the invention have demonstrated an association with schizophrenia and bipolar disorders. However, the present invention also comprises any of the prevention, diagnostic, prognosis and treatment methods described herein using the biallelic markers of the invention in methods of preventing, diagnosing, managing and treating related disorders, particularly related CNS disorders. By way of example, related disorders may comprise psychotic disorders, mood disorders, autism, substance dependence and alcoholism, mental retardation, and other psychiatric diseases including cognitive, anxiety, eating, impulse-control, and personality disorders, as defined with the Diagnosis and Statistical Manual of Mental Disorders fourth edition (DSM-IV) classification".

Recombinant Vectors

The term "vector" is used herein to designate either a circular or a linear DNA or RNA molecule, which is either double-stranded or single-stranded, and which comprise at least one polynucleotide of interest that is sought to be transferred in a cell host or in a unicellular or multicellular host organism.

The present invention encompasses a family of recombinant vectors that comprise a polynucleotide derived from a g35030 nucleic acid sequence. Consequently, the present invention further comprises recombinant vectors comprising: g35030 genomic DNA or cDNAs comprised in the nucleic acids of any of nucleotide positions 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561, 246273 to 247802, 201123 to 247802, 199122 to 201122, 247803 to 249803 and 199122 to 249803 of SEQ ID No. 1, SEQ ID Nos 2 to 17 and primate g35030 DNAs of SEQ ID Nos 79 to 132, and the complements thereof;

Generally, a recombinant vector of the invention may comprise any of the polynucleotides described herein, as well as any g35030 primer or probe as defined above.

In a first preferred embodiment, a recombinant vector of the invention is used to amplify the inserted polynucleotide derived from a g35030 genomic sequence or cDNA of the invention in a suitable cell host, this polynucleotide being amplified at every time that the recombinant vector replicates.

A second preferred embodiment of the recombinant vectors according to the invention comprises expression vectors comprising either a regulatory polynucleotide or a coding nucleic acid of the invention, or both. Within certain embodiments, expression vectors are employed to express a g35030 polypeptide which can be then purified and, for example be used in ligand screening assays or as an immunogen in order to raise specific antibodies directed against a g35030 protein. In other embodiments, the expression vectors are used for constructing transgenic animals and also for gene therapy. Expression requires that appropriate signals are provided in the vectors, said signals including various regulatory elements, such as enhancers/promoters from both viral and mammalian sources that drive expression of the genes of interest in host cells. Dominant drug selection markers for establishing permanent, stable cell clones expressing the products are generally included in the expression vectors of the invention, as they are elements that link expression of the drug selection markers to expression of the polypeptide.

More particularly, the present invention relates to expression vectors which include nucleic acids encoding a g35030 protein or variants or fragments thereof, under the control of a regulatory sequence of the respective g35030 regulatory polynucleotides, or alternatively under the control of an exogenous regulatory sequence.

The invention also pertains to a recombinant expression vector useful for the expression of a g35030 cDNA sequence.

Recombinant vectors comprising a nucleic acid containing a human chromosome 13q31–33-related biallelic marker, or more preferably a g35030-related biallelic marker is also part of the invention. In a preferred embodiment, said biallelic marker is selected from the group consisting of A13 to A65 and the complements thereof.

Some of the elements which can be found in the vectors of the present invention are described in further detail in the following sections.

1. General Features of the Expression Vectors of the Invention

A recombinant vector according to the invention comprises, but is not limited to, a YAC (Yeast Artificial Chromosome), a BAC (Bacterial Artificial Chromosome), a phage, a phagemid, a cosmid, a plasmid or even a linear DNA molecule which may comprise a chromosomal, non-chromosomal, semi-synthetic and synthetic DNA. Such a recombinant vector can comprise a transcriptional unit comprising an assembly of:

(1) a genetic element or elements having a regulatory role in gene expression, for example promoters or enhancers. Enhancers are cis-acting elements of DNA, usually from about 10 to 300 bp in length that act on the promoter to increase the transcription.

(2) a structural or coding sequence which is transcribed into mRNA and eventually translated into a polypeptide, said structural or coding sequence being operably linked to the regulatory elements described in (1); and (3) appropriate transcription initiation and termination sequences. Structural units intended for use in yeast or eukaryotic expression systems preferably include a leader sequence enabling extracellular secretion of translated protein by a host cell. Alternatively, when a recombinant protein is expressed without a leader or transport sequence, it may include a N-terminal residue. This residue may or may not be subsequently cleaved from the expressed recombinant protein to provide a final product.

Generally, recombinant expression vectors will include origins of replication, selectable markers permitting transformation of the host cell, and a promoter derived from a highly expressed gene to direct transcription of a downstream structural sequence. The heterologous structural sequence is assembled in appropriate phase with translation initiation and termination sequences, and preferably a leader sequence capable of directing secretion of the translated protein into the periplasmic space or the extracellular medium. In a specific embodiment wherein the vector is adapted for transfecting and expressing desired sequences in mammalian host cells, preferred vectors will comprise an origin of replication in the desired host, a suitable promoter and enhancer, and also any necessary ribosome binding sites, polyadenylation site, splice donor and acceptor sites, transcriptional termination sequences, and 5'-flanking non-transcribed sequences. DNA sequences derived from the SV40 viral genome, for example SV40 origin, early promoter, enhancer, splice and polyadenylation sites may be used to provide the required non-transcribed genetic elements.

The in vivo expression of a g35030 polypeptide or fragments or variants thereof may be useful in order to correct a genetic defect related to the expression of the native gene in a host organism or to the production of a biologically inactive g35030 protein.

Consequently, the present invention also comprises recombinant expression vectors mainly designed for the in vivo production of the g35030 polypeptide by the introduction of the appropriate genetic material in the organism of the patient to be treated. In preferred embodiments, said genetic material comprises at least one nucleotide sequence selected from the group of nucleotide positttion ranges consisting of: g35030 genomic DNA or cDNAs comprised in the nucleic acids of any of nucleotide positions 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561, 246273 to 247802, 201123 to 247802, 199122 to 201122, 247803 to 249803 and 199122 to 249803 of SEQ ID No. 1, SEQ ID Nos 2 to 17 and primate g35030 DNAs of SEQ ID Nos 79 to 132, and the complements thereof;

This genetic material may be introduced in vitro in a cell that has been previously extracted from the organism, the modified cell being subsequently reintroduced in the said organism, directly in vivo into the appropriate tissue.

2. Regulatory Elements

Promoters

The suitable promoter regions used in the expression vectors according to the present invention are chosen taking into account the cell host in which the heterologous gene has to be expressed. The particular promoter employed to control the expression of a nucleic acid sequence of interest is not believed to be important, so long as it is capable of directing the expression of the nucleic acid in the targeted cell. Thus, where a human cell is targeted, it is preferable to position the nucleic acid coding region adjacent to and under the control of a promoter that is capable of being expressed in a human cell, such as, for example, a human or a viral promoter.

A suitable promoter may be heterologous with respect to the nucleic acid for which it controls the expression or alternatively can be endogenous to the native polynucleotide containing the coding sequence to be expressed. Additionally, the promoter is generally heterologous with respect to the recombinant vector sequences within which the construct promoter/coding sequence has been inserted.

Promoter regions can be selected from any desired gene using, for example, CAT (chloramphenicol transferase) vectors and more preferably pKK232-8 and pCM7 vectors.

Preferred bacterial promoters are the LacI, LacZ, the T3 or T7 bacteriophage RNA polymerase promoters, the gpt, lambda PR, PL and trp promoters (EP 0036776), the polyhedrin promoter, or the p10 protein promoter from baculovirus (Kit Novagen) (Smith et al., 1983; O'Reilly et al., 1992), the lambda PR promoter or also the trc promoter.

Eukaryotic promoters include CMV immediate early, HSV thymidine kinase, early and late SV40, LTRs from retrovirus, and mouse metallothionein-L. Selection of a convenient vector and promoter is well within the level of ordinary skill in the art.

The choice of a promoter is well within the ability of a person skilled in the field of genetic engineering. For example, one may refer to the book of Sambrook et al.(1989) or also to the procedures described by Fuller et al.(1996).

Other Regulatory Elements

One will typically desire to include a polyadenylation signal to effect proper polyadenylation of the gene transcript. The nature of the polyadenylation signal is not believed to be crucial to the successful practice of the invention, and any such sequence may be employed such as human growth hormone and SV40 polyadenylation signals. Also contemplated as an element of the expression cassette is a terminator. These elements can serve to enhance message levels and to minimize read through from the cassette into other sequences.

The vector containing the appropriate DNA sequence as described above, more preferably a g35030 gene regulatory polynucleotide, a polynucleotide encoding a g35030 polypeptide comprising at least one nucleotide sequence selected from the group of nucleotide sequence ranges consisting of: g35030 genomic DNA or cDNAs comprised in the nucleic acids of any of nucleotide positions 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561, 246273 to 247802, 201123 to 247802, 199122 to 201122, 247803 to 249803 and 199122 to 249803 of SEQ ID No. 1, SEQ ID Nos 2 to 17 and primate g35030 DNAs of SEQ ID Nos 79 to 132, and the complements thereof.

3. Selectable Markers

Such markers would confer an identifiable change to the cell permitting easy identification of cells containing the expression construct. The selectable marker genes for selection of transformed host cells are preferably dihydrofolate reductase or neomycin resistance for eukaryotic cell culture, TRP1 for *S. cerevisiae* or tetracycline, rifampicin or ampicillin resistance in *E. coli*, or levan saccharase for mycobacteria, this latter marker being a negative selection marker.

4. Preferred Vectors

Bacterial Vectors

As a representative but non-limiting example, useful expression vectors for bacterial use can comprise a selectable marker and a bacterial origin of replication derived from commercially available plasmids comprising genetic elements of pBR322 (ATCC 37017). Such commercial vectors include, for example, pKK223-3 (Pharmacia, Uppsala, Sweden), and GEM1 (Promega Biotec, Madison, Wis., USA).

Large numbers of other suitable vectors are known to those of skill in the art, and commercially available, such as the following bacterial vectors: pQE70, pQE60, pQE-9 (Qiagen), pbs, pD10, phagescript, psiX174, pbluescript SK, pbsks, pNH8A, pNH16A, pNH18A, pNH46A (Stratagene); ptrc99a, pKK223-3, pKK233-3, pDR540, pRIT5 (Pharmacia); pWLNEO, pSV2CAT, pOG44, pXT1, pSG (Stratagene); pSVK3, pBPV, pMSG, pSVL (Pharmacia); pQE-30 (QIAexpress).

Bacteriophage Vectors

The P1 bacteriophage vector may contain large inserts ranging from about 80 to about 100 kb.

The construction of P1 bacteriophage vectors such as p158 or p158/neo8 are notably described by Sternberg (1992, 1994). Recombinant P1 clones comprising g35030 polynucleotide sequences may be designed for inserting large polynucleotides of more than 40 kb (Linton et al., 1993). To generate P1 DNA for transgenic experiments, a preferred protocol is the protocol described by McCormick et al.(1994). Briefly, *E. coli* (preferably strain NS3529) harboring the P1 plasmid are grown overnight in a suitable broth medium containing 25 µg/ml of kanamycin. The P1 DNA is prepared from the *E. coli* by alkaline lysis using the Qiagen Plasmid Maxi kit (Qiagen, Chatsworth, Calif., USA), according to the manufacturer's instructions. The P1 DNA is purified from the bacterial lysate on two Qiagen-tip 500 columns, using the washing and elution buffers contained in the kit. A phenol/chloroform extraction is then performed before precipitating the DNA with 70% ethanol. After solubilizing the DNA in TE (10 mM Tris-HCl, pH 7.4, 1 mM EDTA), the concentration of the DNA is assessed by spectrophotometry.

When the goal is to express a P1 clone comprising a g35030 polynucleotide sequence in a transgenic animal, typically in transgenic mice, it is desirable to remove vector sequences from the P1 DNA fragment, for example by cleaving the P1 DNA at rare-cutting sites within the P1 polylinker (SfiI, NotI or SalI). The P1 insert is then purified from vector sequences on a pulsed-field agarose gel, using methods similar using methods similar to those originally reported for the isolation of DNA from YACs (Schedl et al., 1993a; Peterson et al., 1993, ). At this stage, the resulting purified insert DNA can be concentrated, if necessary, on a Millipore Ultrafree-MC Filter Unit (Millipore, Bedford, Mass., USA—30,000 molecular weight limit) and then dialyzed against microinjection buffer (10 mM Tris-HCl, pH 7.4; 250 µM EDTA) containing 100 mM NaCl, 30 µM spermine, 70 µM spermidine on a microdyalisis membrane (type VS, 0.025 µM from Millipore). The intactness of the purified P1 DNA insert is assessed by electrophoresis on 1% agarose (Sea Kem GTG; FMC Bio-products) pulse-field gel and staining with ethidium bromide.

Baculovirus Vectors

A suitable vector for the expression of a g35030 polypeptide encoded by a polynucleotide of SEQ ID Nos. 1 to 17 or fragments or variants thereof is a baculovirus vector that can be propagated in insect cells and in insect cell lines. A specific suitable host vector system is the pVL1392/1393 baculovirus transfer vector (Pharmingen) that is used to transfect the SF9 cell line (ATCC N°CRL 1711) which is derived from *Spodoptera frugiperda*.

Other suitable vectors for the expression of the g35030 polypeptide encoded by the polynucleotides of SEQ ID Nos. 1 to 17, or fragments or variants thereof in a baculovirus expression system include those described by Chai et al. (1993), Vlasak et al.(1983) and Lenhard et al.(1996).

Viral Vectors

In one specific embodiment, the vector is derived from an adenovirus. Preferred adenovirus vectors according to the invention are those described by Feldman and Steg (1996) or Ohno et al.(1994). Another preferred recombinant adenovirus according to this specific embodiment of the present invention is the human adenovirus type 2 or 5 (Ad 2 or Ad 5) or an adenovirus of animal origin (French patent application N° FR-93.05954).

Retrovirus vectors and adeno-associated virus vectors are generally understood to be the recombinant gene delivery systems of choice for the transfer of exogenous polynucleotides in vivo, particularly to mammals, including humans. These vectors provide efficient delivery of genes into cells, and the transferred nucleic acids are stably integrated into the chromosomal DNA of the host.

Particularly preferred retroviruses for the preparation or construction of retroviral in vitro or in vitro gene delivery vehicles of the present invention include retroviruses selected from the group consisting of Mink-Cell Focus Inducing Virus, Murine Sarcoma Virus, Reticuloendotheliosis virus and Rous Sarcoma virus. Particularly preferred Murine Leukemia Viruses include the 4070A and the 1504A viruses, Abelson (ATCC No VR-999), Friend (ATCC No VR-245), Gross (ATCC No VR-590), Rauscher (ATCC No VR-998) and Moloney Murine Leukemia Virus (ATCC No VR-190; PCT Application No WO 94/24298). Particularly preferred Rous Sarcoma Viruses include Bryan high titer (ATCC Nos VR-334, VR-657, VR-726, VR-659 and VR-728). Other preferred retroviral vectors are those described in Roth et al.(1996), PCT Application No WO 93/25234, PCT Application No WO 94/06920, Roux et al., 1989, Julan et al., 1992 and Neda et al., 1991.

Yet another viral vector system that is contemplated by the invention comprises the adeno-associated virus (AAV). The adeno-associated virus is a naturally occurring defective virus that requires another virus, such as an adenovirus or a herpes virus, as a helper virus for efficient replication and a productive life cycle (Muzyczka et al., 1992). It is also one of the few viruses that may integrate its DNA into non-dividing cells, and exhibits a high frequency of stable integration (Flotte et al., 1992; Samulski et al., 1989; McLaughlin et al., 1989). One advantageous feature of AAV derives from its reduced efficacy for transducing primary cells relative to transformed cells.

BAC Vectors

The bacterial artificial chromosome (BAC) cloning system (Shizuya et al., 1992) has been developed to stably maintain large fragments of genomic DNA (100-300 kb) in *E. coli*. A preferred BAC vector comprises pBeloBAC11 vector that has been described by Kim et al.(1996). BAC libraries are prepared with this vector using size-selected genomic DNA that has been partially digested using enzymes that permit ligation into either the Bam HI or HindIII sites in the vector. Flanking these cloning sites are T7 and SP6 RNA polymerase transcription initiation sites that can be used to generate end probes by either RNA transcription or PCR methods. After the construction of a BAC library in *E. coli*, BAC DNA is purified from the host cell as a supercoiled circle. Converting these circular molecules into a linear form precedes both size determination and introduction of the BACs into recipient cells. The cloning site is flanked by two Not I sites, permitting cloned segments to be excised from the vector by Not I digestion. Alternatively, the DNA insert contained in the pBeloBAC11 vector may be linearized by treatment of the BAC vector with the commercially available enzyme lambda terminase that leads to the cleavage at the unique cosN site, but this cleavage method results in a full length BAC clone containing both the insert DNA and the BAC sequences.

5. Delivery of the Recombinant Vectors

In order to effect expression of the polynucleotides and polynucleotide constructs of the invention, these constructs must be delivered into a cell. This delivery may be accomplished in vitro, as in laboratory procedures for transforming cell lines, or in vivo or ex vivo, as in the treatment of certain diseases states.

One mechanism is viral infection where the expression construct is encapsulated in an infectious viral particle.

Several non-viral methods for the transfer of polynucleotides into cultured mammalian cells are also contemplated by the present invention, and include, without being limited to, calcium phosphate precipitation (Graham et al., 1973; Chen et al., 1987), DEAE-dextran (Gopal, 1985), electroporation (Tur-Kaspa et al., 1986; Potter et al., 1984), direct microinjection (Harland et al., 1985), DNA-loaded liposomes (Nicolau et al., 1982; Fraley et al., 1979), and receptor-mediate transfection (Wu and Wu, 1987; 1988). Some of these techniques may be successfully adapted for in vivo or ex vivo use.

Once the expression polynucleotide has been delivered into the cell, it may be stably integrated into the genome of the recipient cell. This integration may be in the cognate location and orientation via homologous recombination (gene replacement) or it may be integrated in a random, non specific location (gene augmentation). In yet further embodiments, the nucleic acid may be stably maintained in the cell as a separate, episomal segment of DNA. Such nucleic acid segments or "episomes" encode sequences sufficient to permit maintenance and replication independent of or in synchronization with the host cell cycle.

One specific embodiment for a method for delivering a protein or peptide to the interior of a cell of a vertebrate in vivo comprises the step of introducing a preparation comprising a physiologically acceptable carrier and a naked polynucleotide operatively coding for the polypeptide of interest into the interstitial space of a tissue comprising the cell, whereby the naked polynucleotide is taken up into the interior of the cell and has a physiological effect. This is particularly applicable for transfer in vitro but it may be applied to in vivo as well.

Compositions for use in vitro and in vivo comprising a "naked" polynucleotide are described in PCT application N° WO 90/11092 (Vical Inc.) and also in PCT application No. WO 95/11307 (Institut Pasteur, INSERM, Université d'Ottawa) as well as in the articles of Tacson et al.(1996) and of Huygen et al.(1996).

In still another embodiment of the invention, the transfer of a naked polynucleotide of the invention, including a polynucleotide construct of the invention, into cells may be proceeded with a particle bombardment (biolistic), said particles being DNA-coated microprojectiles accelerated to a high velocity allowing them to pierce cell membranes and enter cells without killing them, such as described by Klein et al.(1987).

In a further embodiment, the polynucleotide of the invention may be entrapped in a liposome (Ghosh and Bacchawat, 1991; Wong et al., 1980; Nicolau et al., 1987).

In a specific embodiment, the invention provides a composition for the in vivo production of the g35030 protein or polypeptide described herein. It comprises a naked polynucleotide operatively coding for this polypeptide, in solution in a physiologically acceptable carrier, and suitable for introduction into a tissue to cause cells of the tissue to express the said protein or polypeptide.

The amount of vector to be injected to the desired host organism varies according to the site of injection. As an indicative dose, it will be injected between 0, 1 and 100 µg of the vector in an animal body, preferably a mammal body, for example a mouse body.

In another embodiment of the vector according to the invention, it may be introduced in vitro in a host cell, preferably in a host cell previously harvested from the animal to be treated and more preferably a somatic cell such as a muscle cell. In a subsequent step, the cell that has been transformed with the vector coding for the desired g35030 polypeptide or the desired fragment thereof is reintroduced into the animal body in order to deliver the recombinant protein within the body either locally or systemically.

Cell Hosts

Another object of the invention comprises a host cell that have been transformed or transfected with one of the polynucleotides described herein, and more precisely a polynucleotide comprising a g35030 polynucleotide selected from the group consisting of SEQ ID Nos. 1 to 17 and 79 to 132, or a fragment or a variant thereof. Are included host cells that are transformed (prokaryotic cells) or that are transfected (eukaryotic cells) with a recombinant vector such as one of those described above.

Generally, a recombinant host cell of the invention comprises any one of the polynucleotides or the recombinant vectors described therein.

Preferred host cells used as recipients for the expression vectors of the invention are the following:

a) Prokaryotic host cells: *Escherichia coli* strains (I.E.DH5-α strain), *Bacillus subtilis, Salmonella typhimurium,* and strains from species like Pseudomonas, Streptomyces and Staphylococcus.

b) Eukaryotic host cells: HeLa cells (ATCC N°CCL2; N°CCL2.1; N°CCL2.2), Cv 1 cells (ATCC N°CCL70), COS cells (ATCC N°CRL1650; N°CRL1651), Sf-9 cells (ATCC N°CRL1711), C127 cells (ATCC N° CRL-1804), 3T3 (ATCC N° CRL-6361), CHO (ATCC N° CCL-61), human kidney 293. (ATCC N° 45504; N° CRL-1573) and BHK (ECACC N° 84100501; N° 84111301).

c) Other mammalian host cells.

G35030 gene expression in mammalian, and typically human, cells may be rendered defective with the replacement of a g35030 nucleic acid counterpart in the genome of an animal cell by a g35030 polynucleotide according to the invention. These genetic alterations may be generated by homologous recombination events using specific DNA constructs that have been previously described.

One kind of cell hosts that may be used are mammal zygotes, such as murine zygotes. For example, murine zygotes may undergo microinjection with a purified DNA molecule of interest, for example a purified DNA molecule that has previously been adjusted to a concentration range from 1 ng/ml—for BAC inserts—3 ng/$\mu$l —for P1 bacteriophage inserts—in 10 mM Tris-HCl, pH 7.4, 250 $\mu$M EDTA containing 100 mM NaCl, 30 $\mu$M spermine, and 70 $\mu$M spermidine. When the DNA to be microinjected has a large size, polyamines and high salt concentrations can be used in order to avoid mechanical breakage of this DNA, as described by Schedl et al (1993b).

Any of the polynucleotides of the invention, including the DNA constructs described herein, may be introduced in an embryonic stem (ES) cell line, preferably a mouse ES cell line. ES cell lines are derived from pluripotent, uncommitted cells of the inner cell mass of pre-implantation blastocysts. Preferred ES cell lines are the following: ES-E14TG2a (ATCC n° CRL-1821), ES-D3 (ATCC n° CRL1934 and n° CRL-11632), YS001 (ATCC n° CRL-11776), 36.5 (ATCC n° CRL-11116). To maintain ES cells in an uncommitted state, they are cultured in the presence of growth inhibited feeder cells which provide the appropriate signals to preserve this embryonic phenotype and serve as a matrix for ES cell adherence. Preferred feeder cells are primary embryonic fibroblasts that are established from tissue of day 13- day 14 embryos of virtually any mouse strain, that are maintained in culture, such as described by Abbondanzo et al.(1993) and are inhibited in growth by irradiation, such as described by Robertson (1987), or by the presence of an inhibitory concentration of LIF, such as described by Pease and Williams (1990).

The constructs in the host cells can be used in a conventional manner to produce the gene product encoded by the recombinant sequence.

Following transformation of a suitable host and growth of the host to an appropriate cell density, the selected promoter is induced by appropriate means, such as temperature shift or chemical induction, and cells are cultivated for an additional period.

Cells are typically harvested by centrifugation, disrupted by physical or chemical means, and the resulting crude extract retained for further purification.

Microbial cells employed in the expression of proteins can be disrupted by any convenient method, including freeze-thaw cycling, sonication, mechanical disruption, or use of cell lysing agents. Such methods are well known by the skill artisan.

Transgenic Animals

The terms "transgenic animals" or "host animals" are used herein designate animals that have their genome genetically and artificially manipulated so as to include one of the nucleic acids according to the invention. Preferred animals are non-human mammals and include those belonging to a genus selected from Mus (e.g. mice), Rattus (e.g. rats) and Oryctogalus (e.g. rabbits) which have their genome artificially and genetically altered by the insertion of a nucleic acid according to the invention. In one embodiment, the invention encompasses non-human host mammals and animals comprising a recombinant vector of the invention or a g35030 gene disrupted by homologous recombination with a knock out vector. The invention also encompasses non-human primates comprising a recombinant vector of the invention or a g35030 gene disrupted by homologous recombination with a knock out vector.

The transgenic animals of the invention all include within a plurality of their cells a cloned recombinant or synthetic DNA sequence, more specifically one of the purified or isolated nucleic acids comprising a g35030 polynucleotide or a DNA sequence encoding an antisense polynucleotide such as described in the present specification.

Generally, a transgenic animal according the present invention comprises any one of the polynucleotides, the recombinant vectors and the cell hosts described in the present invention.

In a first preferred embodiment, these transgenic animals may be good experimental models in order to study the diverse pathologies related to cell differentiation, in particular concerning the transgenic animals within the genome of which has been inserted one or several copies of a polynucleotide encoding a native g35030 protein, or alternatively a mutant g35030 protein.

In a second preferred embodiment, these transgenic animals may express a desired polypeptide of interest under the control of regulatory polynucleotides which lead to good yields in the synthesis of this protein of interest, and optionally a tissue specific expression of this protein of interest.

The design of the transgenic animals of the invention may be made according to the conventional techniques well known from the one skilled in the art. For more details regarding the production of transgenic animals, and specifically transgenic mice, it may be referred to U.S. Pat. No. 4,873,191, issued Oct. 10, 1989; U.S. Pat. No. 5,464,764 issued Nov 7, 1995; and U.S. Pat. No. 5,789,215, issued Aug. 4, 1998.

Transgenic animals of the present invention are produced by the application of procedures which result in an animal with a genome that has incorporated exogenous genetic material. The procedure involves obtaining the genetic material, or a portion thereof, which encodes either a g35030 polynucleotide or antisense polynucleotide such as described in the present specification.

A recombinant polynucleotide of the invention is inserted into an embryonic or ES stem cell line. The insertion is preferably made using electroporation, such as described by Thomas et al.(1987). The cells subjected to electroporation are screened (e.g. by selection via selectable markers, by PCR or by Southern blot analysis) to find positive cells which have integrated the exogenous recombinant polynucleotide into their genome, preferably via an homologous recombination event. An illustrative positive-negative selection procedure that may be used according to the invention is described by Mansour et al.(1988).

Then, the positive cells are isolated, cloned and injected into 3.5 days old blastocysts from mice, such as described by Bradley (1987). The blastocysts are then inserted into a female host animal and allowed to grow to term.

Alternatively, the positive ES cells are brought into contact with embryos at the 2.5 days old 8–16 cell stage (morulae) such as described by Wood et al.(1993) or by Nagy et al.(1993), the ES cells being internalized to colonize extensively the blastocyst including the cells which will give rise to the germ line.

The offspring of the female host are tested to determine which animals are transgenic e.g. include the inserted exogenous DNA sequence and which are wild-type.

Thus, the present invention also concerns a transgenic animal containing a nucleic acid, a recombinant expression vector or a recombinant host cell according to the invention.

Recombinant Cell Lines Derived from the Transgenic Animals of the Invention

A further object of the invention comprises recombinant host cells obtained from a transgenic animal described herein. In one embodiment the invention encompasses cells derived from non-human host mammals and animals comprising a recombinant vector of the invention or a gene comprising a g35030 nucleic acid sequence disrupted by homologous recombination with a knock out vector.

Recombinant cell lines may be established in vitro from cells obtained from any tissue of a transgenic animal according to the invention, for example by transfection of primary cell cultures with vectors expressing onc-genes such as SV40 large T antigen, as described by Chou (1989) and Shay et al.(1991).

Assays for Identification of Compounds for Treatment of Schizophrenia and Bipolar Disorder The present invention provides assays which may be used to test compounds for their ability to treat CNS disorders, and in particular, to ameliorate symptoms of a CNS disorder mediated by g35030. In preferred embodiments, compounds tested for their ability to ameliorate syptoms of schizophrenia or bipolar disorder mediated by g35030. Compounds may also be tested for their ability to treat related disorders, including among others psychotic disorders, mood disorders, autism, substance dependence and alcoholism, mental retardation, and other psychiatric diseases including cognitive, anxiety, eating, impulse-control, and personality disorders, as defined with the Diagnosis and Statistical Manual of Mental Disorders fourth edition (DSM-IV) classification.

The present invention also provides cell and animal, including primate and mouse, models of schizophrenia, bipolar disorder and related disorders.

In one aspect, provided are non-cell based, cell based and animal based assays for the identification of such compounds that affect g35030 activity. g35030 activity may be affected by any mechanism; in certain embodiments, g35030 activity is affected by modulating g35030 gene expression or the activity of the g35030 gene product.

The present methods allow the identification of compounds that affect g35030 activity directly or indirectly. Thus, the non-cell based, cell based and animal assays of the present invention may also be used to identify compounds that act on an element of a g35030 pathway other tha g35030 itself. These compounds can then be used as a therapeutic treatment to modulate g35030 and other gene products involved in schizophrenia, bipolar disorder and related disorders.

Cell and Non-cell Based Assays

In one aspect, cell based assays using recombinant or non-recombinant cells may be used to identify compounds which modulate g35030 activity.

In one aspect, a cell based assay of the invention encompasses a method for identifying a test compound for the treatment of schizophrenia or bipolar disorder comprising (a) exposing a cell to a test compound at a concentration and time sufficient to ameliorate an endpoint related to schizophrenia or bipolar disorder, and (b) determining the level of g35030 activity in a cell. g35030 activity can be measured, for example, by assaying a cell for mRNA transcript level, g35030 peptide expression, localization or protein activity. Preferably the test compound is a compound capable of or suspected to be capable of ameliorating a symptom of schizophrenia, bipolar disorder or a related disorder. Test compounds capable of modulating g35030 activity may be selected for use in developing medicaments. Such cell based assays are further described herein in the section titled "Method For Screening Ligands That Modulate The Expression Of The g35030 Gene."

In another aspect, a cell based assay of the invention encompasses a method for identifying a compound for the treatment of schizophrenia or bipolar disorder comprising (a) exposing a cell to a level of g35030 activity sufficient to cause a schizophrenia-related or bipolar disorder-related endpoint, and (b) exposing said cell to a test compound. A test compound can then be selected according to its ability to ameliorate said schizophrenia-related or bipolar disorder-related endpoints. g35030 activity may be provided by any suitable method, including but not limited to providing a vector containing a g35030 nucleotide sequence, treating said cell with a compound capable of increasing g35030 expression, and treating said cell with a g35030 peptide. Preferably said cell is treated with a g35030 peptide comprising a contiguous span of at least 4 amino acids of SEQ ID Nos. 18 to 23. Preferably the test compound is a compound capable of or suspected to be capable of ameliorating a symptom of schizophrenia, bipolar disorder or a related disorder; alternatively, the test compound is suspected of exacerbating an endpoint schizophrenia, bipolar disorder or a related disorder. A test compound capable of ameliorating any detectable symptom or endpoint of a schizophrenia, bipolar disorder or a related disorder may be selected for use in developing medicaments.

In another embodiment, the invention provides cell and non-cell based assays to g35030 to determine whether g35030 peptides bind to the cell surface, and to identify compounds for the treatment of schizophrenia, bipolar disorder and related disorders that interact with a g35030 receptor. In one such embodiment, a g35030 polynucleotide, or fragments thereof, is cloned into expression vectors such as those described herein. The proteins are purified by size, charge, immunochromatography or other techniques familiar to those skilled in the art. Following purification, the proteins are labeled using techniques known to those skilled in the art. The labeled proteins are incubated with cells or cell lines derived from a variety of organs or tissues to allow the proteins to bind to any receptor present on the cell surface. Following the incubation, the cells are washed to remove non-specifically bound protein. The labeled proteins are detected by autoradiography. Alternatively, unlabeled proteins may be incubated with the cells and detected with antibodies having a detectable label, such as a fluorescent molecule, attached thereto. Specificity of cell surface binding may be analyzed by conducting a competition analysis in which various amounts of unlabeled protein are incubated along with the labeled protein. The amount of labeled protein bound to the cell surface decreases as the amount of competitive unlabeled protein increases. As a control, various amounts of an unlabeled protein unrelated to the labeled protein is included in some binding reactions. The amount of labeled protein bound to the cell surface does not decrease in binding reactions containing increasing amounts of unrelated unlabeled protein, indicating that the protein encoded by the nucleic acid binds specifically to the cell surface.

In another embodiment, the present invention comprises non-cell based binding assays, wherein a g35030 polypeptide is prepared and purified as in cell based binding assays described above. Following purification, the proteins are labeled and incubated with a cell membrane extract or isolate derived from any desired cells from any organs, tissue or combination of organs or tissues of interest to allow the g35030 polypeptide to bind to any receptor present on a membrane. Following the incubation, the membranes are washed to remove non-specifically bound protein. The labeled proteins may be detected by autoradiography. Specificity of membrane binding of g35030 may be analyzed by conducting a competition analysis in which various amounts of a test compound are incubated along with the labeled protein. Any desired test compound, including test polypeptides, can be incubated with the cells. The test compounds may be detected with antibodies having a detectable label, such as a fluorescent molecule, attached thereto. The amount of labeled g35030 polypeptide bound to the cell surface decreases as the amount of competitive test compound increases. As a control, various amounts of an unlabeled protein or a compound unrelated to the test compound is included in some binding reactions. Test compounds capable of reducing the amount of g35030 bound to cell membranes may be selected as a candidate therapeutic compound.

Said cell based assays may comprise cells of any suitable origin; particularly preferred cells are human cells, primate cells, non-human primate cells and mouse cells. If non-human primate cells are used, the g35030 may comprise a nucleotide sequence or be encoded by a nucleotide sequence according to the primate nucleic acid sequences of SEQ ID No. 79 to 132, or a sequence complementary thereto or a fragment thereof.

Animal Model Based Assay

Non-human animal based assays may also be used to identify compounds which modulate g35030 activity. The invention encompasses animal models and animal based assays, including non-transgenic or transgenic animals, including animals containing a human or altered form of the g35030 gene.

Thus, the present invention comprises treating an animal affected by schizophrenia or bipolar disorder or symptoms thereof with a test compound capable of directly or indirectly modulating g35030 activity.

In one aspect, an animal based assay of the invention encompasses a method for identifying a test compound for the treatment of schizophrenia or bipolar disorder comprising (a) exposing an animal to a test compound at a concentration and time sufficient to ameliorate an endpoint related to schizophrenia or bipolar disorder, and (b) determining the level of g35030 activity at a site in said animal. g35030 activity can be measured in any suitable cell, tissue or site. Preferably the test compound is a compound capable of or suspected to be capable of ameliorating a symptom of schizophrenia, bipolar disorder or a related disorder. Optionally said test compound is capable or suspected to be capable of modulating g35030 activity. Test compounds capable of modulating g35030 activity may be selected for use in developing medicaments.

In another aspect, an animal based assay of the invention encompasses a method for identifying a compound for the treatment of schizophrenia or bipolar disorder comprising (a) exposing an animal to a level of g35030 activity sufficient to cause a schizophrenia-related or bipolar disorder-related symptom or endpoint, and (b) exposing said animal to a test compound. A test compound can then be selected according to its ability to ameliorate said schizophrenia-related or bipolar disorder-related endpoints. g35030 activity may be provided by any suitable method, including but not limited to providing a vector containing a g35030 nucleotide sequence, treating said animal with a compound capable of increasing g35030 expression and treating said cell with a g35030 peptide. Preferably, said animal is treated with a g35030 peptide comprising a contiguous span of at least 4 amino acids of SEQ ID Nos. 18 to 23. Preferably the test compound is a compound capable of or suspected to be capable of ameliorating a symptom of schizophrenia, bipolar disorder or a related disorder; alternatively, the test compound is suspected of exacerbating a symptom of schizophrenia, bipolar disorder or a related disorder. A test compound capable of ameliorating any detectable symptom or endpoint of a schizophrenia, bipolar disorder or a related disorder may be selected for use in developing medicaments.

Any suitable animal may be used. Preferably, said animal is a primate, a non-human primate, a mammal, or a mouse.

In one embodiment, a mouse is treated with a g35030 peptide, exposed to a test compound, and symptoms indicative of schizophrenia, bipolar disorder or a related disorder are assessed by observing stereotypy. In other embodiments, said symptoms are assessed by performing at least one test from the group consisting of home cage observation, neurological evaluation, stress-induced hypothermia, forced swim, PTZ seizure, locomotor activity, tail suspension, elevated plus maze, novel object recognition, prepulse inhibition, thermal pain, Y-maze, and metabolic chamber tests (Psychoscreen™ tests available from Psychogenics Inc.). Other tests are known in Crawley et al, Horm. Behav. 31(3):197–211 (1997); Crawley, Brain Res 835(1): 18–26 (1999) for example.

Any suitable test compound may be used with the screening methods of the invention. Examples of compounds that may be screened by the methods of the present invention include small organic or inorganic molecules, nucleic acids, including polynucleotides from random and directed polynucleotide libraries, peptides, including peptides derived from random and directed peptide libraries, soluble peptides, fusion peptides, and phosphopeptides, antibodies including polyclonal, monoclonal, chimeric, humanized, and anti-idiotypic antibodies, and single chain antibodies, FAb, F(ab')$_2$ and FAb expression library fragments, and epitope-binding fragments thereof. In certain aspects, a compound capable of ameliorating or exacerbating a symptom or endpoint of schizophrenia, bipolar disorder or a related disorder may include, by way of example, antipsychotic drugs in general, neuroleptics, atypical neuroleptics, antidepressants, anti-anxiety drugs, noradrenergic agonists and antagonists, dopaminergic agonists and antagonists, serotonin reuptake inhibitors, benzodiazepines.

Methods for Screening Substances Interacting with a g35030 Polypeptides

For the purpose of the present invention, a ligand means a molecule, such as a protein, a peptide, an antibody or any synthetic chemical compound capable of binding to the g35030 protein or one of its fragments or variants or to modulate the expression of the polynucleotide coding for the g35030 or a fragment or variant thereof.

In the ligand screening method according to the present invention, a biological sample or a defined molecule to be tested as a putative ligand of the g35030 protein is brought into contact with the corresponding purified g35030 protein, for example the corresponding purified recombinant g35030 protein produced by a recombinant cell host as described hereinbefore, in order to form a complex between this protein and the putative ligand molecule to be tested.

As an illustrative example, to study the interaction of the g35030 protein, or a fragment comprising a contiguous span of at least 4 amino acids, preferably at least 6, or preferably at least 8 to 10 amino acids, more preferably at least 12, 15, 20, 25, 30, 40, 50, or 100 amino acids of SEQ ID Nos 18 to 23, with drugs or small molecules, such as molecules generated through combinatorial chemistry approaches, the microdialysis coupled to HPLC method described by Wang et al. (1997) or the affinity capillary electrophoresis method described by Bush et al. (1997), can be used.

In further methods, peptides, drugs, fatty acids, lipoproteins, or small molecules which interact with the g35030 protein, or a fragment comprising a contiguous span of at least 4 amino acids, preferably at least 6, or preferably at least 8 to 10 amino acids, more preferably at least 12, 15, 20, 25, 30, 40, 50, or 100 amino acids of SEQ ID Nos 18 to 23, may be identified using assays such as the following. The molecule to be tested for binding is labeled with a detectable label, such as a fluorescent, radioactive, or enzymatic tag and placed in contact with immobilized g35030 protein, or a fragment thereof under conditions which permit specific binding to occur. After removal of non-specifically bound molecules, bound molecules are detected using appropriate means.

Another object of the present invention comprises methods and kits for the screening of candidate substances that interact with a g35030 polypeptide.

The present invention pertains to methods for screening substances of interest that interact with a g35030 protein or one fragment or variant thereof. By their capacity to bind covalently or non-covalently to a g35030 protein or to a fragment or variant thereof, these substances or molecules may be advantageously used both in vitro and in vivo.

In vitro, said interacting molecules may be used as detection means in order to identify the presence of a g35030 protein in a sample, preferably a biological sample.

A method for the screening of a candidate substance comprises the following steps
  a) providing a polypeptide comprising, consisting essentially of, or consisting of a g35030 protein or a fragment comprising a contiguous span of at least 4 amino acids, preferably at least 6 amino acids, more preferably at least 8 to 10 amino acids, more preferably at least 12, 15, 20, 25, 30, 40, 50, or 100 amino acids of SEQ ID Nos. 18 to 23;
  b) obtaining a candidate substance;
  c) bringing into contact said polypeptide with said candidate substance; and
  d) detecting the complexes formed between said polypeptide and said candidate substance.

The invention further concerns a kit for the screening of a candidate substance interacting with the g35030 polypeptide, wherein said kit comprises:
  a) a g35030 protein having an amino acid sequence selected from the group consisting of the amino acid sequences of SEQ ID Nos. 18 to 23 or a peptide fragment comprising a contiguous span of at least 4 amino acids, preferably at least 6 amino acids, more preferably at least 8 to 10 amino acids, and more preferably at least 12, 15, 20, 25, 30, 40, 50, or 100 amino acids of SEQ ID Nos. 18 to 23; and
  b) optionally means useful to detect the complex formed between the g35030 protein or a peptide fragment or a variant thereof and the candidate substance.

In a preferred embodiment of the kit described above, the detection means comprise monoclonal or polyclonal antibodies directed against the g35030 protein or a peptide fragment or a variant thereof.

Various candidate substances or molecules can be assayed for interaction with a g35030 polypeptide. These substances or molecules include, without being limited to, natural or synthetic organic compounds or molecules of biological origin such as polypeptides. When the candidate substance or molecule comprise a polypeptide, this polypeptide may be the resulting expression product of a phage clone belonging to a phage-based random peptide library, or alternatively the polypeptide may be the resulting expression product of a cDNA library cloned in a vector suitable for performing a two-hybrid screening assay.

The invention also pertains to kits useful for performing the hereinbefore described screening method. Preferably, such kits comprise a g35030 polypeptide or a fragment or a variant thereof, and optionally means useful to detect the complex formed between the g35030 polypeptide or its fragment or variant and the candidate substance. In a preferred embodiment the detection means comprise monoclonal or polyclonal antibodies directed against the corresponding g35030 polypeptide or a fragment or a variant thereof.

A. Candidate Ligands Obtained from Random Peptide Libraries

In a particular embodiment of the screening method, the putative ligand is the expression product of a DNA insert contained in a phage vector (Parmley and Smith, 1988). Specifically, random peptide phages libraries are used. The random DNA inserts encode for peptides of 8 to 20 amino acids in length (Oldenburg K. R. et al., 1992; Valadon P., et al., 1996; Lucas A. H., 1994; Westerink M. A. J., 1995; Felici F. et al., 1991). According to this particular embodiment, the recombinant phages expressing a protein that binds to the immobilized g35030 protein is retained and the complex formed between the g35030 protein and the recombinant phage may be subsequently immunoprecipitated by a polyclonal or a monoclonal antibody directed against the g35030 protein.

Once the ligand library in recombinant phages has been constructed, the phage population is brought into contact with the immobilized g35030 protein. Then the preparation of complexes is washed in order to remove the non-specifically bound recombinant phages. The phages that bind specifically to the g35030 protein are then eluted by a buffer (acid pH) or immunoprecipitated by the monoclonal antibody produced by the hybridoma anti- g35030, and this phage population is subsequently amplified by an over-infection of bacteria (for example E. coli). The selection step may be repeated several times, preferably 2–4 times, in order to select the more specific recombinant phage clones. The last step comprises characterizing the peptide produced by the selected recombinant phage clones either by expression in infected bacteria and isolation, expressing the phage insert in another host-vector system, or sequencing the insert contained in the selected recombinant phages.

B. Candidate Ligands Obtained by Competition Experiments

Alternatively, peptides, drugs or small molecules which bind to the g35030 protein, or a fragment comprising a contiguous span of at least 4 amino acids, preferably at least 6 amino acids, more preferably at least 8 to 10 amino acids, and more preferably at least 12, 15, 20, 25, 30, 40, 50, or 100 amino acids of SEQ ID Nos. 18 to 23, may be identified in competition experiments. In such assays, the g35030 protein, or a fragment thereof, is immobilized to a surface, such as a plastic plate. Increasing amounts of the peptides, drugs or small molecules are placed in contact with the immobilized g35030 protein, or a fragment thereof, in the presence of a detectable labeled known g35030 protein ligand. For example, the g35030 ligand may be detectably labeled with a fluorescent, radioactive, or enzymatic tag. The ability of the test molecule to bind the g35030 protein, or a fragment thereof, is determined by measuring the amount of detectably labeled known ligand bound in the presence of the test molecule. A decrease in the amount of known ligand bound to the g35030 protein, or a fragment thereof, when the test molecule is present indicated that the test molecule is able to bind to the g35030 protein, or a fragment thereof.

C. Candidate Ligands Obtained by Affinity Chromatography

Proteins or other molecules interacting with the g35030 protein, or a fragment comprising a contiguous span of at 4 amino acids, preferably at least 6 amino acids, more preferably at least 8 to 10 amino acids, and more preferably at least 12, 15, 20, 25, 30, 40, 50, or 100 amino acids of SEQ ID Nos 18 to 23, can also be found using affinity columns which contain the g35030 protein, or a fragment thereof. The g35030 protein, or a fragment thereof, may be attached to the column using conventional techniques including chemical coupling to a suitable column matrix such as agarose, Affi Gel®, or other matrices familiar to those of skill in art. In some embodiments of this method, the affinity column contains chimeric proteins in which the g35030 protein, or a fragment thereof, is fused to glutathion S transferase (GST). A mixture of cellular proteins or pool of expressed proteins as described above is applied to the affinity column. Proteins or other molecules interacting with the g35030 protein, or a fragment thereof, attached to the column can then be isolated and analyzed on 2-D electrophoresis gel as described in Ramunsen et al. (1997). Alternatively, the proteins retained on the affinity column can be purified by electrophoresis based methods and sequenced. The same method can be used to isolate antibodies, to screen phage display products, or to screen phage display human antibodies.

D. Candidate Ligands Obtained by Optical Biosensor Methods

Proteins interacting with the g35030 protein, or a fragment comprising a contiguous span of at least 4 amino acids, preferably at least 6 amino acids, more preferably at least 8 to 10 amino acids, and more preferably at least 12, 15, 20, 25, 30,40, 50, or 100 amino acids of SEQ ID Nos. 18 to 23, can also be screened by using an Optical Biosensor as described in Edwards and Leatherbarrow (1997) and also in Szabo et al. (1995). This technique permits the detection of interactions between molecules in real time, without the need of labeled molecules. This technique is based on the surface plasmon resonance (SPR) phenomenon. Briefly, the candidate ligand molecule to be tested is attached to a surface (such as a carboxymethyl dextran matrix). A light beam is directed towards the side of the surface that does not contain the sample to be tested and is reflected by said surface. The SPR phenomenon causes a decrease in the intensity of the reflected light with a specific association of angle and wavelength. The binding of candidate ligand molecules cause a change in the refraction index on the surface, which change is detected as a change in the SPR signal. For screening of candidate ligand molecules or substances that are able to interact with the g35030 protein, or a fragment thereof, the g35030 protein, or a fragment thereof, is immobilized onto a surface. This surface comprises one side of a cell through which flows the candidate molecule to be assayed. The binding of the candidate molecule on the g35030 protein, or a fragment thereof, is detected as a change of the SPR signal. The candidate molecules tested may be proteins, peptides, carbohydrates, lipids, or small molecules generated by combinatorial chemistry. This technique may also be performed by immobilizing eukaryotic or prokaryotic cells or lipid vesicles exhibiting an endogenous or a recombinantly expressed g35030 protein at their surface.

The main advantage of the method is that it allows the determination of the association rate between the g35030 protein and molecules interacting with the g35030 protein. It is thus possible to select specifically ligand molecules interacting with the g35030 protein, or a fragment thereof, through strong or conversely weak association constants.

E. Candidate Ligands Obtained Through a Two-hybrid Screening Assay

The yeast two-hybrid system is designed to study protein-protein interactions in vivo (Fields and Song, 1989), and relies upon the fusion of a bait protein to the DNA binding domain of the yeast Gal4 protein. This technique is also described in the U.S. Pat. Nos. 5,667,973 and the 5,283,173 (Fields et al.).

The general procedure of library screening by the two-hybrid assay may be performed as described by Harper et al. (1993) or as described by Cho et al. (1998) or also Fromont-Racine et al. (1997).

The bait protein or polypeptide comprises, consists essentially of, or consists of a g35030 polypeptide or a fragment comprising a contiguous span of at least 4 amino acids, preferably at least 6 amino acids, more preferably at least 8 to 10 amino acids, and more preferably at least 12, 15, 20, 25,30, 40, 50, or 100 amino acids of SEQ ID Nos. 18 to 23.

More precisely, the nucleotide sequence encoding the g35030 polypeptide or a fragment or variant thereof is fused to a polynucleotide encoding the DNA binding domain of the GAL4 protein, the fused nucleotide sequence being inserted in a suitable expression vector, for example pAS2 or pM3.

Then, a human cDNA library is constructed in a specially designed vector, such that the human cDNA insert is fused to a nucleotide sequence in the vector that encodes the transcriptional domain of the GAL4 protein. Preferably, the vector used is the pACT vector. The polypeptides encoded by the nucleotide inserts of the human cDNA library are termed "pray" polypeptides.

A third vector contains a detectable marker gene, such as beta galactosidase gene or CAT gene that is placed under the control of a regulation sequence that is responsive to the binding of a complete Gal4 protein containing both the transcriptional activation domain and the DNA binding domain. For example, the vector pG5EC may be used.

Two different yeast strains are also used. As an illustrative but non limiting example the two different yeast strains may be the followings:

Y190, the phenotype of which is (MATa, Leu2-3, 112 ura3-12, trp1-901, his3-D200, ade2-101, gal4Dgal180D URA3 GAL-LacZ, LYS GAL-HIS3, cyh');

Y187, the phenotype of which is (MATa gal4 gal80 his3 trp1-901 ade2-101 ura3-52 leu2-3, -112 URA3 GAL-lacZmet$^-$), which is the opposite mating type of Y190.

Briefly, 20 μg of pAS2/g35030 and 20 μg of pACT-cDNA library are co-transformed into yeast strain Y190. The transformants are selected for growth on minimal media lacking histidine, leucine and tryptophan, but containing the histidine synthesis inhibitor 3-AT (50 mM). Positive colonies are screened for beta galactosidase by filter lift assay. The double positive colonies (His$^+$, beta-gal$^+$) are then grown on plates lacking histidine, leucine, but containing tryptophan and cycloheximide (10 mg/ml) to select for loss of pAS2/g35030 plasmids by retention of pACT-cDNA library plasmids. The resulting Y190 strains are mated with Y187 strains expressing g35030 or non-related control proteins; such as cyclophilin B, lamin, or SNF1, as Gal4 fusions as described by Harper et al. (1993) and by Bram et al. (Bram R J et al., 1993), and screened for beta galactosidase by filter lift assay. Yeast clones that are beta gal- after mating with the control Gal4 fusions are considered false positives.

In another embodiment of the two-hybrid method according to the invention, interaction between the g35030 or a fragment or variant thereof with cellular proteins may be assessed using the Matchmaker Two Hybrid System 2 (Catalog No. K1604-1, Clontech). As described in the manual accompanying the Matchmaker Two Hybrid System 2 (Catalog No. K 1604-1, Clontech), nucleic acids encoding the g35030 protein or a portion thereof, are inserted into an expression vector such that they are in frame with DNA encoding the DNA binding domain of the yeast transcriptional activator GALA. A desired cDNA, preferably human cDNA, is inserted into a second expression vector such that they are in frame with DNA encoding the activation domain of GAL4. The two expression plasmids are transformed into yeast and the yeast are plated on selection medium which selects for expression of selectable markers on each of the expression vectors as well as GAL4 dependent expression of the HIS3 gene. Transformants capable of growing on medium lacking histidine are screened for GAL4 dependent lacZ expression. Those cells which are positive in both the histidine selection and the lacZ assay contain interaction between g35030 and the protein or peptide encoded by the initially selected cDNA insert.

Method for Screening Substances Interacting with the Regulatory Sequences of a g35030 Gene The present invention also concerns a method for screening substances or molecules that are able to interact with the regulatory sequences of the g35030 gene, such as for example promoter or enhancer sequences.

Nucleic acids encoding proteins which are able to interact with the regulatory sequences of the g35030 gene, more particularly a nucleotide sequence selected from the group consisting of the polynucleotides of the 5' and 3' regulatory region or a fragment or variant thereof, and preferably a variant comprising one of the biallelic markers of the invention, may be identified by using a one-hybrid system, such as that described in the booklet enclosed in the Matchmaker One-Hybrid System kit from Clontech (Catalog Ref. n° K1603-1). Briefly, the target nucleotide sequence is cloned upstream of a selectable reporter sequence and the resulting DNA construct is integrated in the yeast genome (*Saccharomyces cerevisiae*). The yeast cells containing the reporter sequence in their genome are then transformed with a library comprising fusion molecules between cDNAs encoding candidate proteins for binding onto the regulatory sequences of the g35030 gene and sequences encoding the activator domain of a yeast transcription factor such as GAL4. The recombinant yeast cells are plated in a culture broth for selecting cells expressing the reporter sequence. The recombinant yeast cells thus selected contain a fusion protein that is able to bind onto the target regulatory sequence of the g35030 gene. Then, the cDNAs encoding the fusion proteins are sequenced and may be cloned into expression or transcription vectors in vitro. The binding of the encoded polypeptides to the target regulatory sequences of the g35030 gene may be confirmed by techniques familiar to the one skilled in the art, such as gel retardation assays or DNAse protection assays.

Gel retardation assays may also be performed independently in order to screen candidate molecules that are able to interact with the regulatory sequences of the g35030 gene, such as described by Fried and Crothers (1981), Garner and Revzin (1981) and Dent and Latchman (1993). These techniques are based on the principle according to which a DNA fragment which is bound to a protein migrates slower than the same unbound DNA fragment. Briefly, the target nucleotide sequence is labeled. Then the labeled target nucleotide sequence is brought into contact with either a total nuclear extract from cells containing transcription factors, or with different candidate molecules to be tested. The interaction between the target regulatory sequence of the g35030 gene and the candidate molecule or the transcription factor is detected after gel or capillary electrophoresis through a retardation in the migration.

Method for Screening Ligands that Modulate the Expression of the g35030 Gene

Another subject of the present invention is a method for screening molecules that modulate the expression of the g35030 protein. Such a screening method comprises the steps of:

a) cultivating a prokaryotic or an eukaryotic cell that has been transfected with a nucleotide sequence encoding the g35030 protein or a variant or a fragment thereof, placed under the control of its own promoter;

b) bringing into contact the cultivated cell with a molecule to be tested;

c) quantifying the expression of the g35030 protein or a variant or a fragment thereof.

In an embodiment, the nucleotide sequence encoding the g35030 protein or a variant or a fragment thereof comprises an allele of at least one g35030 related biallelic marker.

Using DNA recombination techniques well known by the one skill in the art, the g35030 protein encoding DNA sequence is inserted into an expression vector, downstream from its promoter sequence. As an illustrative example, the promoter sequence of the g35030 gene is contained in the nucleic acid of the 5' regulatory region.

The quantification of the expression of the g35030 protein may be realized either at the mRNA level or at the protein level. In the latter case, polyclonal or monoclonal antibodies may be used to quantify the amounts of the g35030 protein that have been produced, for example in an ELISA or a RIA assay.

In a preferred embodiment, the quantification of the g35030 mRNA is realized by a quantitative PCR amplification of the cDNA obtained by a reverse transcription of the total mRNA of the cultivated g35030 -transfected host cell, using a pair of primers specific for g35030.

The present invention also concerns a method for screening substances or molecules that are able to increase, or in contrast to decrease, the level of expression of the g35030 gene. Such a method may allow the one skilled in the art to select substances exerting a regulating effect on the expression level of the g35030 gene and which may be useful as active ingredients included in pharmaceutical compositions for treating patients suffering from diseases.

Thus, is also part of the present invention a method for screening of a candidate substance or molecule that modulated the expression of the g35030 gene, this method comprises the following steps:

providing a recombinant cell host containing a nucleic acid, wherein said nucleic acid comprises a nucleotide sequence of the 5' regulatory region or a biologically active fragment or variant thereof located upstream a polynucleotide encoding a detectable protein;

obtaining a candidate substance; and determining the ability of the candidate substance to modulate the expression levels of the polynucleotide encoding the detectable protein.

In a further embodiment, the nucleic acid comprising the nucleotide sequence of the 5' regulatory region or a biologically active fragment or variant thereof also includes a 5'UTR region of the g35030 cDNA of SEQ ID No 2 to 17, or one of its biologically active fragments or variants thereof.

Among the preferred polynucleotides encoding a detectable protein, there may be cited polynucleotides encoding beta galactosidase, green fluorescent protein (GFP) and chloramphenicol acetyl transferase (CAT).

The invention also pertains to kits useful for performing the herein described screening method. Preferably, such kits comprise a recombinant vector that allows the expression of a nucleotide sequence of the 5' regulatory region or a biologically active fragment or variant thereof located upstream and operably linked to a polynucleotide encoding a detectable protein or the g35030 protein or a fragment or a variant thereof.

In another embodiment of a method for the screening of a candidate substance or molecule that modulates the expression of the g35030 gene, wherein said method comprises the following steps:

a) providing a recombinant host cell containing a nucleic acid, wherein said nucleic acid comprises a 5'UTR sequence of a g35030 cDNA, preferably of a g35030, or one of its biologically active fragments or variants, the 5'UTR sequence or its biologically active fragment or variant being operably linked to a polynucleotide encoding a detectable protein;

b) obtaining a candidate substance; and c) determining the ability of the candidate substance to modulate the expression levels of the polynucleotide encoding the detectable protein.

In a specific embodiment of the above screening method, the nucleic acid that comprises a nucleotide sequence selected from the group consisting of the 5'UTR sequence of a g35030 cDNA, preferably of a g35030 or one of its biologically active fragments or variants, includes a promoter sequence which is endogenous with respect to the g35030 5'UTR sequence.

In another specific embodiment of the above screening method, the nucleic acid that comprises a nucleotide sequence selected from the group consisting of the 5'UTR sequence of a g35030 cDNA or one of its biologically active fragments or variants, includes a promoter sequence which is exogenous with respect to the g35030 5'UTR sequence defined therein.

In a further preferred embodiment, the nucleic acid comprising the 5'-UTR sequence of a g35030 cDNA or the biologically active fragments thereof includes a g35030-related biallelic marker.

The invention further comprises a kit for the screening of a candidate substance modulating the expression of the g35030 gene, wherein said kit comprises a recombinant vector that comprises a nucleic acid including a 5'UTR sequence of the g35030 cDNA of SEQ ID Nos 2 to 17, or one of their biologically active fragments or variants, the 5'UTR sequence or its biologically active fragment or variant being operably linked to a polynucleotide encoding a detectable protein.

For the design of suitable recombinant vectors useful for performing the screening methods described above, it will be referred to the section of the present specification wherein the preferred recombinant vectors of the invention are detailed.

Expression levels and patterns of g35030 may be analyzed by solution hybridization with long probes as described in International Patent Application No. WO 97/05277. Briefly, the g35030 cDNA or the g35030 genomic DNA described above, or fragments thereof, is inserted at a cloning site immediately downstream of a bacteriophage (T3, T7 or SP6) RNA polymerase promoter to produce antisense RNA. Preferably, the g35030 insert comprises at least 100 or more consecutive nucleotides of the genomic DNA sequence or the cDNA sequences. The plasmid is linearized and transcribed in the presence of ribonucleotides comprising modified ribonucleotides (i.e. biotin-UTP and DIG-UTP). An excess of this doubly labeled RNA is hybridized in solution with mRNA isolated from cells or tissues of interest. The hybridization is performed under standard stringent conditions (40–50° C. for 16 hours in an 80% formamide, 0.4 M NaCl buffer, pH 7–8). The unhybridized probe is removed by digestion with ribonucleases specific for single-stranded RNA (i.e. RNases CL3, T1, Phy M, U2 or A). The presence of the biotin-UTP modification enables capture of the hybrid on a microtitration plate coated with streptavidin. The presence of the DIG modification enables the hybrid to be detected and quantified by ELISA using an anti-DIG antibody coupled to alkaline phosphatase.

Quantitative analysis of g35030 gene expression may also be performed using arrays. As used herein, the term array means a one dimensional, two dimensional, or multidimensional arrangement of a plurality of nucleic acids of sufficient length to permit specific detection of expression of mRNAs capable of hybridizing thereto. For example, the arrays may contain a plurality of nucleic acids derived from genes whose expression levels are to be assessed. The arrays may include the g35030 genomic DNA, the g35030 cDNA sequences or the sequences complementary thereto or fragments thereof, particularly those comprising at least one of the biallelic markers according the present invention. Preferably, the fragments are at least 15 nucleotides in length. In other embodiments, the fragments are at least 25 nucleotides in length. In some embodiments, the fragments are at least 50 nucleotides in length. More preferably, the fragments are at least 100 nucleotides in length. In another preferred embodiment, the fragments are more than 100 nucleotides in length. In some embodiments the fragments may be more than 500 nucleotides in length.

For example, quantitative analysis of g35030 gene expression may be performed with a complementary DNA microarray as described by Schena et al.(1995 and 1996). Full length g35030 cDNAs or fragments thereof are amplified by PCR and arrayed from a 96-well microtiter plate onto silylated microscope slides using high-speed robotics. Printed arrays are incubated in a humid chamber to allow rehydration of the array elements and rinsed, once in 0.2% SDS for 1 min, twice in water for 1 min and once for 5 min in sodium borohydride solution. The arrays are submerged in water for 2 min at 95° C., transferred into 0.2% SDS for 1 min, rinsed twice with water, air dried and stored in the dark at 25° C.

Cell or tissue mRNA is isolated or commercially obtained and probes are prepared by a single round of reverse transcription. Probes are hybridized to 1 cm$^2$ microarrays under a 14×14 mm glass coverslip for 6–12 hours at 60° C. Arrays are washed for 5 min at 25° C. in low stringency wash buffer (1×SSC/0.2% SDS), then for 10 min at room temperature in high stringency wash buffer (0.1×SSC/0.2% SDS). Arrays are scanned in 0.1×SSC using a fluorescence laser scanning device fitted with a custom filter set. Accurate differential expression measurements are obtained by taking the average of the ratios of two independent hybridizations.

Quantitative analysis of g35030 gene expression may also be performed with full length g35030 cDNAs or fragments thereof in complementary DNA arrays as described by Pietu et al.(1996). The full length g35030 cDNA or fragments thereof is PCR amplified and spotted on membranes. Then, mRNAs originating from various tissues or cells are labeled with radioactive nucleotides. After hybridization and washing in controlled conditions, the hybridized mRNAs are detected by phospho-imaging or autoradiography. Duplicate experiments are performed and a quantitative analysis of differentially expressed mRNAs is then performed.

Alternatively, expression analysis using the g35030 genomic DNA, the g35030 cDNA, or fragments thereof can be done through high density nucleotide arrays as described by Lockhart et al.(1996) and Sosnowsky et al.(1997). Oligonucleotides of 15–50 nucleotides from the sequences of the g35030 genomic DNA, the g35030 cDNA sequences particularly those comprising at least one of biallelic markers according to the present invention, or the sequences complementary thereto, are synthesized directly on the chip (Lockhart et al., supra) or synthesized and then addressed to the chip (Sosnowski et al., supra). Preferably, the oligonucleotides are about 20 nucleotides in length.

g35030 cDNA probes labeled with an appropriate compound, such as biotin, digoxigenin or fluorescent dye, are synthesized from the appropriate mRNA population and then randomly fragmented to an average size of 50 to 100 nucleotides. The said probes are then hybridized to the chip. After washing as described in Lockhart et al., supra and application of different electric fields (Sosnowsky et al., 1997)., the dyes or labeling compounds are detected and quantified. Duplicate hybridizations are performed. Comparative analysis of the intensity of the signal originating from cDNA probes on the same target oligonucleotide in different cDNA samples indicates a differential expression of g35030 mRNA.

Methods for Inhibiting the Expression of A g35030 Gene

Other therapeutic compositions according to the present invention comprise advantageously an oligonucleotide fragment of the nucleic sequence of g35030 as an antisense tool or a triple helix tool that inhibits the expression of the corresponding g35030 gene. A preferred fragment of the nucleic sequence of g35030 comprises an allele of at least one of the biallelic markers of the invention.

Antisense Approach

Preferred methods using antisense polynucleotide according to the present invention are the procedures described by Sczakiel et al.(1995).

Preferably, the antisense tools are chosen among the polynucleotides (15–200 bp long) that are complementary to the 5' end of the g35030 mRNA. In another embodiment, a combination of different antisense polynucleotides complementary to different parts of the desired targeted gene are used.

Preferred antisense polynucleotides according to the present invention are complementary to a sequence of the mRNAs of g35030 that contains either the translation initiation codon ATG or a splicing donor or acceptor site.

The antisense nucleic acids should have a length and melting temperature sufficient to permit formation of an intracellular duplex having sufficient stability to inhibit the expression of the g35030 mRNA in the duplex. Strategies for designing antisense nucleic acids suitable for use in gene therapy are disclosed in Green et al., (1986) and Izant and Weintraub, (1984).

In some strategies, antisense molecules are obtained by reversing the orientation of the g35030 coding region with respect to a promoter so as to transcribe the opposite strand from that which is normally transcribed in the cell. The antisense molecules may be transcribed using in vitro transcription systems such as those which employ T7 or SP6 polymerase to generate the transcript. Another approach involves transcription of g35030 antisense nucleic acids in vivo by operably linking DNA containing the antisense sequence to a promoter in a suitable expression vector.

Alternatively, suitable antisense strategies are those described by Rossi et al.(1991), in the International Applications Nos. WO 94/23026, WO 95/04141, WO 92/18522 and in the European Patent Application No. EP 0 572 287 A2

An alternative to the antisense technology that is used according to the present invention comprises using ribozymes that will bind to a target sequence via their complementary polynucleotide tail and that will cleave the corresponding RNA by hydrolyzing its target site (namely "hammerhead ribozymes"). Briefly, the simplified cycle of a hammerhead ribozyme comprises (1) sequence specific binding to the target RNA via complementary antisense sequences; (2) site-specific hydrolysis of the cleavable motif of the target strand; and (3) release of cleavage products, which gives rise to another catalytic cycle. Indeed, the use of long-chain antisense polynucleotide (at least 30 bases long) or ribozymes with long antisense arms are advantageous. A preferred delivery system for antisense ribozyme is achieved by covalently linking these antisense ribozymes to lipophilic groups or to use liposomes as a convenient vector. Preferred antisense ribozymes according to the present invention are prepared as described by Sczakiel et al.(1995).

Triple Helix Approach

The g35030 genomic DNA may also be used to inhibit the expression of the g35030 gene based on intracellular triple helix formation.

Triple helix oligonucleotides are used to inhibit transcription from a genome. They are particularly useful for studying alterations in cell activity when it is associated with a particular gene.

Similarly, a portion of the g35030 genomic DNA can be used to study the effect of inhibiting g35030 transcription within a cell. Traditionally, homopurine sequences were considered the most useful for triple helix strategies. However, homopyrimidine sequences can also inhibit gene expression. Such homopyrimidine oligonucleotides bind to the major groove at homopurine:homopyrimidine sequences. Thus, both types of sequences from the g35030 genomic DNA are contemplated within the scope of this invention.

To carry out gene therapy strategies using the triple helix approach, the sequences of the g35030 genomic DNA are first scanned to identify 10-mer to 20-mer homopyrimidine or homopurine stretches which could be used in triple-helix based strategies for inhibiting g35030 expression. Following identification of candidate homopyrimidine or homopurine stretches, their efficiency in inhibiting g35030 expression is assessed by introducing varying amounts of oligonucleotides containing the candidate sequences into tissue culture cells which express the g35030 gene.

The oligonucleotides can be introduced into the cells using a variety of methods known to those skilled in the art, including but not limited to calcium phosphate precipitation, DEAE-Dextran, electroporation, liposome-mediated transfection or native uptake.

Treated cells are monitored for altered cell function or reduced g35030 expression using techniques such as Northern blotting, RNase protection assays, or PCR based strategies to monitor the transcription levels of the g35030 gene in cells which have been treated with the oligonucleotide.

The oligonucleotides which are effective in inhibiting gene expression in tissue culture cells may then be introduced in vivo using the techniques described above in the antisense approach at a dosage calculated based on the in vitro results, as described in antisense approach.

In some embodiments, the natural (beta) anomers of the oligonucleotide units can be replaced with alpha anomers to render the oligonucleotide more resistant to nucleases. Further, an intercalating agent such as ethidium bromide, or the like, can be attached to the 3' end of the alpha oligonucleotide to stabilize the triple helix. For information on the generation of oligonucleotides suitable for triple helix formation see Griffin et al.(1989).

Pharmaceutical Compositions and Formulations

G35030-modulating Compounds

Using the methods disclosed herein, compounds that selectively modulate g35030 activity in vitro and in vivo may be identified. The compounds identified by the process of the invention include, for example, antibodies having binding specificity for the g35030 peptide. It is also expected that homologues of g35030 may be useful for modulating g35030-mediated activity and the related physiological condition associated with schizophrenia or bipolar disorder. Generally, it is further expected that assay methods of the present invention based on the role of g35030 in central nervous system disorder may be used to identify compounds capable of intervening in the assay cascade of the invention.

Indications

While g35030 has demonstrated an association with schizophrenia and bipolar disorder, indications involving g35030 may include various central nervous system disorders. Nervous system disorders are expected to have complex genetic bases and often share certain symptoms. In particular, as described herein, indications may include schizophrenia and other psychotic disorders, mood disorders, autism, substance dependence and alcoholism, mental retardation, and other psychiatric diseases including cognitive, anxiety, eating, impulse-control, and personality disorders, as defined with the Diagnosis and Statistical Manual of Mental Disorders fourth edition (DSM-IV) classification.

Pharmaceutical Formulations and Routes of Administration

The compounds identified using the methods of the present invention can be administered to a mammal, including a human patient, alone or in pharmaceutical compositions where they are mixed with suitable carriers or excipient(s) at therapeutically effective doses to treat or ameliorate schizophrenia or bipolar disorder related disorders. A therapeutically effective dose further refers to that amount of the compound sufficient to result in amelioration of symptoms as determined by the methods described herein. Preferably, a therapeutically effective dosage is suitable for continued periodic use or administration. Techniques for formulation and administration of the compounds of the instant application may be found in "Remington's Pharmaceutical Sciences," Mack Publishing Co., Easton, Pa., latest edition.

Routes of Administration

Suitable routes of administration include oral, rectal, transmucosal, or intestinal administration, parenteral delivery, including intramuscular, subcutaneous, intramedullary injections, as well as intrathecal, direct intraventricular, intravenous, intraperitoneal, intranasal or intraocular injections. A particularly useful method of administering compounds for treating central nervous system disease involves surgical implantation of a device for delivering the compound over an extended period of time. Sustained release formulations of the invented medicaments particularly are contemplated.

Composition/Formulation

Pharmaceutical compositions and medicaments for use in accordance with the present invention may be formulated in a conventional manner using one or more physiologically acceptable carriers comprising excipients and auxiliaries. Proper formulation is dependent upon the route of administration chosen.

For injection, the agents of the invention may be formulated in aqueous solutions, preferably in physiologically compatible buffers such as Hanks's solution, Ringer's solution, or physiological saline buffer such as a phosphate or bicarbonate buffer. For transmucosal administration, penetrants appropriate to the barrier to be permeated are used in the formulation. Such penetrants are generally known in the art.

Pharmaceutical preparations which can be used orally include push-fit capsules made of gelatin, as well as soft, sealed capsules made of gelatin and a plasticizer, such as glycerol or sorbitol. The push-fit capsules can contain the active ingredients in admixture with fillers such as lactose, binders such as starches, and/or lubricants such as talc or magnesium stearate and, optionally, stabilizers. In soft capsules, the active compounds may be dissolved or suspended in suitable liquids, such as fatty oils, liquid paraffin, or liquid polyethylene glycols. In addition, stabilizers may be added. All formulations for oral administration should be in dosages suitable for such administration.

For buccal administration, the compositions may take the form of tablets or lozenges formulated in conventional manner.

For administration by inhalation, the compounds for use according to the present invention are conveniently delivered in the form of an aerosol spray presentation from pressurized packs or a nebulizer, with the use of a suitable gaseous propellant, e.g., carbon dioxide. In the case of a pressurized aerosol the dosage unit may be determined by providing a valve to deliver a metered amount. Capsules and cartridges of, e.g., gelatin, for use in an inhaler or insufflator, may be formulated containing a powder mix of the compound and a suitable powder base such as lactose or starch.

The compounds may be formulated for parenteral administration by injection, e.g., by bolus injection or continuous infusion. Formulations for injection may be presented in unit dosage form, e.g., in ampoules or in multi-dose containers, with an added preservative. The compositions may take such forms as suspensions, solutions or emulsions in aqueous vehicles, and may contain formulatory agents such as suspending, stabilizing and/or dispersing agents.

Pharmaceutical formulations for parenteral administration include aqueous solutions of the active compounds in water-soluble form. Aqueous suspensions may contain substances which increase the viscosity of the suspension, such as sodium carboxymethyl cellulose, sorbitol, or dextran. Optionally, the suspension may also contain suitable stabilizers or agents which increase the solubility of the compounds to allow for the preparation of highly concentrated solutions.

Alternatively, the active ingredient may be in powder or lyophilized form for constitution with a suitable vehicle, such as sterile pyrogen-free water, before use.

In addition to the formulations described previously, the compounds may also be formulated as a depot preparation.

Such long acting formulations may be administered by implantation (for example subcutaneously or intramuscularly) or by intramuscular injection. Thus, for example, the compounds may be formulated with suitable polymeric or hydrophobic materials (for example as an emulsion in an acceptable oil) or ion exchange resins, or as sparingly soluble derivatives, for example, as a sparingly soluble salt.

Additionally, the compounds may be delivered using a sustained-release system, such as semipermeable matrices of solid hydrophobic polymers containing the therapeutic agent. Various sustained release materials have been established and are well known by those skilled in the art. Sustained-release capsules may, depending on their chemical nature, release the compounds for a few weeks up to over 100 days.

Depending on the chemical nature and the biological stability of the therapeutic reagent, additional strategies for protein stabilization may be employed.

The pharmaceutical compositions also may comprise suitable solid or gel phase carriers or excipients. Examples of such carriers or excipients include but are not limited to calcium carbonate, calcium phosphate, various sugars, starches, cellulose derivatives, gelatin, and polymers such as polyethylene glycols.

Effective Dosage

Pharmaceutical compositions suitable for use in the present invention include compositions wherein the active ingredients are contained in an effective amount to achieve their intended purpose. More specifically, a therapeutically effective amount means an amount effective to prevent development of or to alleviate the existing symptoms of the subject being treated. Determination of the effective amounts is well within the capability of those skilled in the art, especially in light of the detailed disclosure provided herein.

For any compound used in the method of the invention, the therapeutically effective dose can be estimated initially from cell culture assays, and a dose can be formulated in animal models. Such information can be used to more accurately determine useful doses in humans.

A therapeutically effective dose refers to that amount of the compound that results in amelioration of symptoms in a patient. Toxicity and therapeutic efficacy of such compounds can be determined by standard pharmaceutical procedures in cell cultures or experimental animals, e.g., for determining the LD50, (the dose lethal to 50% of the test population) and the ED50 (the dose therapeutically effective in 50% of the population). The dose ratio between toxic and therapeutic effects is the therapeutic index and it can be expressed as the ratio between LD50 and ED50. Compounds which exhibit high therapeutic indices are preferred.

The data obtained from these cell culture assays and animal studies can be used in formulating a range of dosage for use in human. The dosage of such compounds lies preferably within a range of circulating concentrations that include the ED50, with little or no toxicity. The dosage may vary within this range depending upon the dosage form employed and the route of administration utilized. The exact formulation, route of administration and dosage can be chosen by the individual physician in view of the patient's condition. (See, e.g., Fingl et al., 1975, in "The Pharmacological Basis of Therapeutics", Ch. 1).

Computer-Related Embodiments

As used herein the term "nucleic acid codes of the invention" encompass the nucleotide sequences comprising, consisting essentially of, or consisting of any one of the following:

a) a contiguous span of at least 12, 15, 18, 20, 25, 30, 35, 40, 50, 60, 70, 80, 90, 100, 150, 200, 500, 1000 or 2000 nucleotides of SEQ ID No. 1, and the complements thereof, wherein said contiguous span comprises at least one of the following nucleotide positions of SEQ ID No 1: 201123 to 247802 and 199122 to 249803;

b) a contiguous span of at least 8, 12, 15, 18, 20, 25, 30, 35, 40, 45, 50, 55, 60, 65, 70, 75, 80, 90, 100 or 200 nucleotides, to the extent that such a length is consistent with the particular sequence ID, of SEQ ID Nos. 2 to 17 or the complements thereof, c) a contiguous span of at least 12, 15, 18, 20, 25, 30, 35, 40, 50, 60, 70, 80, 90, 100, 150, 200, 500, 1000 or 2000 nucleotides of any of SEQ ID Nos. 24, 25, 28 and 74, and the complements thereof, to the extent that such a length is consistent with the particular sequence ID;

d) a contiguous span of at least 12, 15, 18, 20, 25, 30, 35, 40, 50, 60, 70, 80, 90, 100, 150, 200, 500, 1000 or 2000 nucleotides of any of SEQ ID Nos. 79 to 132, and the complements thereof, to the extent that such a length is consistent with the particular sequence ID;

e) a contiguous span of at least 12, 15, 18, 20, 25, 30, 35, 40, 45, 50, 55, 60, 65, 70, 75, 80, 90 or 100 nucleotides of SEQ ID No. 1 or the complements thereof wherein said contiguous span comprises at least one of the following nucleotide positions of SEQ ID No 1: 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561, 246273 to 247802, 199122 to 201122 and 247803 to 249803;

f) a contiguous span according to a), b), c), d) or e), wherein said span includes a biallelic marker;

g) a contiguous span according to a), b), c), d) or e), wherein said span includes a biallelic marker selected from the group consisting of A13 to A18, A20 to A46, A49 to A52, A55, A57, A59 to A63, A72 to A73, A76 and A123 ; and h) a contiguous span according to f), wherein said span includes a biallelic marker with the alternative allele present at said biallelic marker; The "nucleic acid codes of the invention" further encompass nucleotide sequences homologous to a contiguous span of at least 30, 35, 40, 50, 60, 70, 80, 90, 100, 150, 200, 500, 1000 or 2000 nucleotides, to the extent that such a length is consistent with the particular sequence of SEQ ID Nos. 1 to 17, 24, 25, 28, 74 and 79 to 132, and the complements thereof.

The "nucleic acid codes of the invention" also encompass nucleotide sequences homologous to a contiguous span of at least 12, 15, 18, 20, 25, 30, 35, 40, 45, 50, 55, 60, 65, 70, 75, 80, 90 or 100 nucleotides of SEQ ID No. 1 or the complements thereof, wherein said contiguous span comprises at least one of the following nucleotide positions of SEQ ID No. 1: 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561, 246273 to 247802, 201123 to 247802, 199122 to 201122, 247803 to 249803 and 199122 to 249803.

Homologous sequences refer to a sequence having at least 99%, 98%, 97%, 96%, 95%, 90%, 85%, 80%, or 75% homology to these contiguous spans. Homology may be determined using any method described herein, including BLAST2N with the default parameters or with any modified parameters. Homologous sequences also may include RNA sequences in which uridines replace the thymines in the nucleic acid codes of the invention. It will be appreciated that the nucleic acid codes of the invention can be represented in the traditional single character format (See the inside back cover of Stryer, Lubert. *Biochemistry*, 3$^{rd}$ edition. W. H Freeman & Co., New York.) or in any other format or code which records the identity of the nucleotides in a sequence.

As used herein the term "polypeptide codes of SEQ ID Nos. 18 to 23" encompasses the polypeptide sequence of SEQ ID Nos 18 to 23, polypeptide sequences homologous to the polypeptides of SEQ ID Nos. 18 to 23, or fragments of any of the preceding sequences. Homologous polypeptide sequences refer to a polypeptide sequence having at least 99%, 98%, 97%, 96%, 95%, 90%, 85%, 80%, 75% homology to one of the polypeptide sequences of SEQ ID Nos. 18 to 23. Homology may be determined using any of the computer programs and parameters described herein, including FASTA with the default parameters or with any modified parameters. The homologous sequences may be obtained using any of the procedures described herein or may result from the correction of a sequencing error as described above. The polypeptide fragments comprise at least 4, 6, 8, 10, 15, 20, 25,30, 35,40, 50, 75, 100, or 150 consecutive amino acids of the polypeptides of SEQ ID Nos. 18 to 23. Preferably, the fragments are novel fragments. It will be appreciated that the polypeptide codes of the SEQ ID Nos. 18 to 23 can be represented in the traditional single character format or three letter format (See the inside back cover of Starrier, Lubert. *Biochemistry*, 3$^{rd}$ edition. W. H Freeman & Co., New York.) or in any other format which relates the identity of the polypeptides in a sequence.

It will be appreciated by those skilled in the art that the nucleic acid codes of SEQ ID Nos. 1 to 17, 24, 25, 28, 74 and 79 to 132 and polypeptide codes of SEQ ID Nos. 18 to 23 can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate embodiment comprising one or more of nucleic acid codes of SEQ ID Nos. 1 to 17, 24, 25, 28, 74 and 79 to 132, or one or more of the polypeptide codes of SEQ ID Nos. 18 to 23. Another aspect of the present invention is a computer readable medium having recorded thereon at least 2, 5, 10, 15, 20, 25, 30, or 50 nucleic acid codes of SEQ ID Nos 1 to 17, 24, 25, 28, 74 and 79 to 132. Another aspect of the present invention is a computer readable medium having recorded thereon at least 2, 5,10, 15, 20, 25, 30, or 50 polypeptide codes of SEQ ID Nos 18 to 23.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Embodiments of the present invention include systems, particularly computer systems which store and manipulate the sequence information described herein. One example of a computer system 100 is illustrated in block diagram form in FIG. 12. As used herein, "a computer system" refers to the hardware components, software components, and data storage components used to analyze the nucleotide sequences of the nucleic acid codes of SEQ ID Nos 1 to 17, 24, 25, 28, 74 and 79 to 132, or the amino acid sequences of the polypeptide codes of SEQ ID Nos. 18 to 23. In one embodiment, the computer system 100 is a Sun Enterprise 1000 server (Sun Microsystems, Palo Alto, Calif.). The. computer system 100 preferably includes a processor for processing, accessing and manipulating the sequence data. The processor 105 can be any well-known type of central processing unit, such as the Pentium III from Intel Corporation, or similar processor from Sun, Motorola, Compaq or International Business Machines.

Preferably, the computer system 100 is a general purpose system that comprises the processor 105 and one or more internal data storage components 110 for storing data, and one or more data retrieving devices for retrieving the data stored on the data storage components. A skilled artisan can readily appreciate that any one of the currently available computer systems are suitable.

In one particular embodiment, the computer system 100 includes a processor 105 connected to a bus which is connected to a main memory 115 (preferably implemented as RAM) and one or more internal data storage devices 110, such as a hard drive and/or other computer readable media having data recorded thereon. In some embodiments, the computer system 100 further includes one or more data retrieving device 118 for reading the data stored on the internal data storage devices 110.

The data retrieving device 118 may represent, for example, a floppy disk drive, a compact disk drive, a magnetic tape drive, etc. In some embodiments, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125a–c in a network or wide area network to provide centralized access to the computer system 100.

Software for accessing and processing the nucleotide sequences of the nucleic acid codes of SEQ ID Nos. 1 to 17, 24, 25, 28, 74 and 79 to 132, or the amino acid sequences of the polypeptide codes of SEQ ID Nos. 18 to 23 (such as search tools, compare tools, and modeling tools etc.) may reside in main memory 115 during execution.

In some embodiments, the computer system 100 may further comprise a sequence comparer for comparing the above-described nucleic acid codes of SEQ ID Nos. 1 to 17, 24, 25, 28, 74 and 79 to 132 or polypeptide codes of SEQ ID Nos. 18 to 23 stored on a computer readable medium to reference nucleotide or polypeptide sequences stored on a computer readable medium. A "sequence comparer" refers to one or more programs which are implemented on the computer system 100 to compare a nucleotide or polypeptide sequence with other nucleotide or polypeptide sequences and/or compounds including but not limited to peptides, peptidomimetics, and chemicals stored within the data storage means. For example, the sequence comparer may compare the nucleotide sequences of the nucleic acid codes of SEQ ID Nos. 1 to 17, 24, 25, 28, 74 and 79 to 132, or the amino acid sequences of the polypeptide codes of SEQ ID Nos. 18 to 23 stored on a computer readable medium to reference sequences stored on a computer readable medium to identify homologies, motifs implicated in biological function, or structural motifs. The various sequence comparer programs identified elsewhere in this patent specification are particularly contemplated for use in this aspect of the invention.

FIG. 13 is a flow diagram illustrating one embodiment of a process 200 for comparing a new nucleotide or protein sequence with a database of sequences in order to determine the homology levels between the new sequence and the sequences in the database. The database of sequences can be a private database stored within the computer system 100, or a public database such as GENBANK, PIR OR SWIS-SPROT that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the present invention is a computer system comprising a processor, a data storage device having stored thereon a nucleic acid code of SEQ ID NOs. 1 to 17, 24, 25, 28, 74 and 79 to 132 or a polypeptide code of SEQ ID Nos 18 to 23, a data storage device having retrievably stored thereon reference nucleotide sequences or polypeptide sequences to be compared to the nucleic acid code of SEQ ID Nos. 1 to 17, 24, 25, 28, 74 and 79 to 132 or polypeptide code of SEQ ID Nos. 18 to 23 and a sequence comparer for conducting the comparison. The sequence comparer may indicate a homology level between the sequences compared or identify structural motifs in the above described nucleic acid code of SEQ ID Nos. 1 to 17, 24, 25, 28, 74 and 79 to 132 and polypeptide codes of SEQ ID Nos. 18 to 23, or it may identify structural motifs in sequences which are compared to these nucleic acid codes and polypeptide codes. In some embodiments, the data storage device may have stored thereon the sequences of at least 2,5, 10, 15, 20, 25, 30, or 50 of the nucleic acid codes of SEQ ID Nos. 1 to 17, 24, 25, 28, 74 and 79 to 132 or polypeptide codes of SEQ ID Nos. 18 to 23.

Another aspect of the present invention is a method for determining the level of homology between a nucleic acid code of SEQ ID Nos. 1 to 17, 24,25, 28, 74 and 79 to 132 and a reference nucleotide sequence, comprising the steps of reading the nucleic acid code and the reference nucleotide sequence through the use of a computer program which determines homology levels and determining homology between the nucleic acid code and the reference nucleotide sequence with the computer program. The computer program may be any of a number of computer programs for determining homology levels, including those specifically enumerated herein, including BLAST2N with the default parameters or with any modified parameters. The method may be implemented using the computer systems described above. The method may also be performed by reading 2, 5, 10, 15, 20, 25, 30, or 50 of the above described nucleic acid codes of SEQ ID Nos. 1 to 17, 24, 25, 28, 74 and 79 to 132 through use of the computer program and determining homology between the nucleic acid codes and reference nucleotide sequences .

FIG. 14 is a flow diagram illustrating one embodiment of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it should be in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there aren't any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of the nucleic acid codes of the present invention, to reference nucleotide sequences in order to determine whether the nucleic acid code of SEQ ID Nos. 1 to 17, 24, 25, 28, 74 and 79 to 132 differs from a reference nucleic acid sequence at one or more positions. Optionally such a program records the length and identity of inserted, deleted or substituted nucleotides with respect to the sequence of either the reference polynucleotide or the nucleic acid code of SEQ ID Nos. 1 to 17, 24, 25, 28, 74 and 79 to 132. In one embodiment, the computer program may be a program which determines whether the nucleotide sequences of the nucleic acid codes of SEQ ID Nos. 1 to 17, 24, 25, 28, 74 and 79 to 132 contain a biallelic marker or single nucleotide polymorphism (SNP) with respect to a reference nucleotide sequence. This single nucleotide polymorphism may comprise a single base substitution, insertion, or deletion, while this biallelic marker may comprise abour one to ten consecutive bases substituted, inserted or deleted.

Another aspect of the present invention is a method for determining the level of homology between a polypeptide code of SEQ ID Nos. 18 to 23 and a reference polypeptide sequence, comprising the steps of reading the polypeptide code of SEQ ID Nos. 18 to 23 and the reference polypeptide sequence through use of a computer program which determines homology levels and determining homology between the polypeptide code and the reference polypeptide sequence using the computer program.

Accordingly, another aspect of the present invention is a method for determining whether a nucleic acid code of SEQ ID Nos. 1 to 17, 24, 25, 28, 74 and 79 to 132 differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms. The method may be implemented by the computer systems described above and the method illustrated in FIG. 14. The method may also be performed by reading at least 2, 5, 10, 15, 20, 25, 30, or 50 of the nucleic acid codes of SEQ ID Nos. 1 to 17, 24,25, 28, 74 and 79 to 132 and the reference nucleotide sequences through the use of the computer program and identifying differences between the nucleic acid codes and the reference nucleotide sequences with the computer program.

In other embodiments the computer based system may further comprise an identifier for identifying features within the nucleotide sequences of the nucleic acid codes of SEQ ID Nos. 1 to 17, 24, 25, 28, 74 and 79 to 132 or the amino acid sequences of the polypeptide codes of SEQ ID Nos. 18to23.

An "identifier" refers to one or more programs which identifies certain features within the above-described nucleotide sequences of the nucleic acid codes of SEQ ID Nos. 1 to 17, 24, 25, 28, 74 and 79 to 132 or the amino acid sequences of the polypeptide codes of SEQ ID Nos. 18 to 23.

In one embodiment, the identifier may comprise a program which identifies an open reading frame in the cDNAs codes of SEQ ID Nos 2 to 17 and 36 to 40.

FIG. 15 is a flow diagram illustrating one embodiment of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group (www.gcg.com).

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence.

It should be noted, that if the feature attribute is not found in the first sequence at the decision state 316, the process 300 moves directly to the decision state 320 in order to determine if any more features exist in the database.

In another embodiment, the identifier may comprise a molecular modeling program which determines the 3-dimensional structure of the polypeptides codes of SEQ ID Nos. 18 to 23. In some embodiments, the molecular modeling program identifies target sequences that are most compatible with profiles representing the structural environments of the residues in known three-dimensional protein structures. (See, e.g., Eisenberg et al., U.S. Pat. No. 5,436,850 issued Jul. 25, 1995). In another technique, the known three-dimensional structures of proteins in a given family are superimposed to define the structurally conserved regions in that family. This protein modeling technique also uses the known three-dimensional structure of a homologous protein to approximate the structure of the polypeptide codes of SEQ ID Nos. 4 to 8. (See e.g., Srinivasan, et al., U.S. Pat. No. 5,557,535 issued Sep. 17, 1996). Conventional homology modeling techniques have been used routinely to build models of proteases and antibodies. (Sowdhamini et al., Protein Engineering 10:207, 215 (1997)). Comparative approaches can also be used to develop three-dimensional protein models when the protein of interest has poor sequence identity to template proteins. In some cases, proteins fold into similar three-dimensional structures despite having very weak sequence identities. For example, the three-dimensional structures of a number of helical cytokines fold in similar three-dimensional topology in spite of weak sequence homology.

The recent development of threading methods now enables the identification of likely folding patterns in a number of situations where the structural relatedness between target and template(s) is not detectable at the sequence level. Hybrid methods, in which fold recognition is performed using Multiple Sequence Threading (MST), structural equivalencies are deduced from the threading output using a distance geometry program DRAGON to construct a low resolution model, and a full-atom representation is constructed using a molecular modeling package such as QUANTA.

According to this 3-step approach, candidate templates are first identified by using the novel fold recognition algorithm MST, which is capable of performing simultaneous threading of multiple aligned sequences onto one or more 3-D structures. In a second step, the structural equivalencies obtained from the MST output are converted into interresidue distance restraints and fed into the distance geometry program DRAGON, together with auxiliary information obtained from secondary structure predictions. The program combines the restraints in an unbiased manner and rapidly generates a large number of low resolution model confirmations. In a third step, these low resolution model confirmations are converted into full-atom models and subjected to energy minimization using the molecular modeling package QUANTA. (See e.g., Aszódi et al., Proteins:Structure, Function, and Genetics, Supplement 1:38–42 (1997)).

The results of the molecular modeling analysis may then be used in rational drug design techniques to identify agents which modulate the activity of the polypeptide codes of SEQ ID Nos. 18 to 23.

Accordingly, another aspect of the present invention is a method of identifying a feature within the nucleic acid codes of SEQ ID Nos. 1 to 17, 24, 25, 28, 74 and 79 to 132 or the polypeptide codes of SEQ ID Nos. 18 to 23 comprising reading the nucleic acid code(s) or the polypeptide code(s) through the use of a computer program which identifies features therein and identifying features within the nucleic acid code(s) or polypeptide code(s) with the computer program. In one embodiment, computer program comprises a computer program which identifies open reading frames. In a further embodiment, the computer program identifies structural motifs in a polypeptide sequence. In another embodiment, the computer program comprises a molecular modeling program. The method may be performed by reading a single sequence or at least 2, 5, 10, 15, 20, 25, 30, or 50 of the nucleic acid codes of SEQ ID Nos. 1 to 17, 24, 25, 28, 74 and 79 to 132 or the polypeptide codes of SEQ ID Nos. 18 to 23 through the use of the computer program and identifying features within the nucleic acid codes or polypeptide codes with the computer program.

The nucleic acid codes of SEQ ID Nos. 1 to 17, 24, 25, 28, 74 and 79 to 132 or the polypeptide codes of SEQ ID Nos. 18 to 23 may be stored and manipulated in a variety of data processor programs in a variety of formats. For example, the nucleic acid codes of SEQ ID Nos. 1 to 17, 24, 25, 28, 74 and 79 to 132 or the polypeptide codes of SEQ ID Nos. 18 to 23 may be stored as text in a word processing file, such as MicrosoftWORD or WORDPERFECT or as an ASCII file in a variety of database programs familiar to those of skill in the art, such as DB2, SYBASE, or ORACLE. In addition, many computer programs and databases may be used as sequence comparers, identifiers, or sources of reference nucleotide or polypeptide sequences to be compared to the nucleic acid codes of SEQ I) Nos. 1 to 17, 24, 25, 28, 74 and 79 to 132 or the polypeptide codes of SEQ ID Nos. 18 to 23. The following list is intended not to limit the invention but to provide guidance to programs and databases which are useful with the nucleic acid codes of SEQ ID Nos. 1 to 17, 24, 25, 28, 74 and 79 to 132 or the polypeptide codes of SEQ ID Nos. 18 to 23. The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, *J. Mol. Biol.* 215: 403 (1990)), FASTA (Pearson and Lipman, *Proc. Natl. Acad. Sci. USA,* 85: 2444 (1988)), FASTDB (Brutlag et al. Comp. App. Biosci. 6:237–245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the EMBL/Swissprotein database, the MDL Available Chemicals Directory database, the MDL Drug Data Report data base, the Comprehensive Medicinal Chemistry database, Derwents's World Drug Index database, the BioByteMasterFile database, the Genbank database, and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

Throughout this application, various publications, patents, and published patent applications are cited. The disclosures of the publications, patents, and published patent specifications referenced in this application are all hereby incorporated by reference in their entireties into the present disclosure to more fully describe the state of the art to which this invention pertains.

EXAMPLES

Several of the methods of the present invention are described in the following examples, which are offered by way of illustration and not by way of limitation. Many other modifications and variations of the invention as herein set forth can be made without departing from the spirit and scope thereof and therefore only such limitations should be imposed as are indicated by the appended claims.

Example 1

Identification of Biallelic Markers—DNA Extraction

Donors were unrelated and healthy. They presented a sufficient diversity for being representative of a heterogeneous population. The DNA from 100 individuals was extracted and tested for the detection of the biallelic markers.

30 ml of peripheral venous blood were taken from each donor in the presence of EDTA. Cells (pellet) were collected after centrifugation for 10 minutes at 2000 rpm. Red cells were lysed by a lysis solution (50 ml final volume: 10 mM Tris pH7.6; 5 mM MgCl$_2$; 10 mM NaCl). The solution was centrifuged (10 minutes, 2000 rpm) as many times as necessary to eliminate the residual red cells present in the supernatant, after resuspension of the pellet in the lysis solution.

The pellet of white cells was lysed overnight at 42° C. with 3.7 ml of lysis solution composed of:

3 ml TE 10-2 (Tris-HCl 10 mM, EDTA 2 mM)/NaCl 0 4 M

200 µl SDS 10%

500 µl K-proteinase (2 mg K-proteinase in TE 10-2/NaCl 0.4 M).

For the extraction of proteins, 1 ml saturated NaCl (6M) (1/3.5 v/v) was added. After vigorous agitation, the solution was centrifuged for 20 minutes at 10000 rpm.

For the precipitation of DNA, 2 to 3 volumes of 100% ethanol were added to the previous supernatant, and the solution was centrifuged for 30 minutes at 2000 rpm. The DNA solution was rinsed three times with 70% ethanol to eliminate salts, and centrifuged for 20 minutes at 2000 rpm. The pellet was dried at 37° C., and resuspended in 1 ml TE 10-1 or 1 ml water. The DNA concentration was evaluated by measuring the OD at 260 nm (1 unit OD=50 µg/ml DNA). To determine the presence of proteins in the DNA solution, the OD 260/OD 280 ratio was determined. Only DNA preparations having a OD 260/OD 280 ratio between 1.8 and 2 were used in the subsequent examples described below.

The pool was constituted by mixing equivalent quantities of DNA from each individual.

Example 2

Identification of Biallelic Markers: Amplification of Genomic DNA by PCR

The amplification of specific genomic sequences of the DNA samples of Example 1 was carried out on the pool of DNA obtained previously. In addition, 50 individual samples were similarly amplified.

PCR assays were performed using the following protocol:

| | |
|---|---|
| Final volume | 25 µl |
| DNA | 2 ng/µl |
| MgCl$_2$ | 2 mM |
| dNTP (each) | 200 µM |
| primer (each) | 2.9 ng/µl |
| Ampli Taq Gold DNA polymerase | 0.05 unit/µl |
| PCR buffer (10x = 0.1 M TrisHCl pH 8.3 0.5 M KCl) | 1x |

Each pair of first primers was designed using the sequence information of genomic DNA sequences of SEQ ID Nos 1 to 78 disclosed herein and the OSP software (Hillier & Green, 1991). This first pair of primers was about 20 nucleotides in length and had the sequences disclosed in Table 4 in the columns labeled "Position range of amplification primer in SEQ ID No." and "Complementary position range of amplification primer in SEQ ID No.".

TABLE 4

| Amplicon | SEQ ID No | Primer name | Position range of amplification primer in SEQ ID | | Primer name | Complementary position range of amplification primer in SEQ ID | |
|---|---|---|---|---|---|---|---|
| 99-27943 | 1 | B1 | 7938 | 7958 | C1 | 8446 | 8465 |
| 99-27935 | 1 | B2 | 21365 | 21385 | C2 | 21845 | 21864 |
| 8-128 | 1 | B3 | 65453 | 65471 | C3 | 65856 | 65874 |
| 99-31960 | 1 | B4 | 95034 | 95053 | C4 | 95543 | 95563 |
| 99-24656 | 1 | B5 | 107022 | 107040 | C5 | 107495 | 107513 |
| 99-24634 | 1 | B6 | 160770 | 160787 | C6 | 161240 | 161257 |
| 99-24639 | 1 | B7 | 160279 | 160298 | C7 | 160785 | 160802 |
| 99-7652 | 1 | B8 | 168813 | 168830 | C8 | 169331 | 169351 |
| 99-16100 | 1 | B9 | 170666 | 170686 | C9 | 171153 | 171173 |
| 99-5862 | 1 | B10 | 173065 | 173085 | C10 | 173495 | 173514 |
| 99-5919 | 1 | B11 | 189753 | 189771 | C11 | 190187 | 190207 |
| 99-24658 | 1 | B12 | 197116 | 197135 | C12 | 197555 | 197572 |
| 8-303 | 1 | B13 | 200587 | 200606 | C13 | 200994 | 201012 |
| 8-300 | 1 | B14 | 202440 | 202459 | C14 | 202852 | 202871 |
| 8-299 | 1 | B15 | 203061 | 203080 | C15 | 203486 | 203505 |
| 8-296 | 1 | B16 | 203943 | 203962 | C16 | 204345 | 204362 |
| 99-24644 | 1 | B17 | 204741 | 204758 | C17 | 205222 | 205240 |
| 8-252 | 1 | B18 | 204373 | 204392 | C18 | 204777 | 204794 |
| 8-295 | 1 | B19 | 205034 | 205052 | C19 | 205435 | 205453 |
| 8-293 | 1 | B20 | 205768 | 205786 | C20 | 206175 | 206193 |
| 8-292 | 1 | B21 | 206316 | 206333 | C21 | 206725 | 206742 |
| 8-251 | 1 | B22 | 207186 | 207205 | C22 | 207616 | 207634 |
| 8-289 | 1 | B23 | 208186 | 208205 | C23 | 208588 | 208606 |
| 8-287 | 1 | B24 | 208786 | 208805 | C24 | 209189 | 209208 |
| 8-285 | 1 | B25 | 209520 | 209539 | C25 | 209931 | 209949 |
| 8-283 | 1 | B26 | 210219 | 210237 | C26 | 210620 | 210638 |
| 8-282 | 1 | B27 | 210801 | 210820 | C27 | 211205 | 211223 |
| 8-281 | 1 | B28 | 211182 | 211199 | C28 | 211596 | 211613 |
| 8-279 | 1 | B29 | 212290 | 212309 | C29 | 212698 | 212716 |
| 8-278 | 1 | B30 | 212662 | 212679 | C30 | 213091 | 213109 |
| 8-277 | 1 | B31 | 213783 | 213803 | C31 | 214062 | 214082 |
| 8-124 | 1 | B32 | 214564 | 214581 | C32 | 214965 | 214983 |
| 8-273 | 1 | B33 | 215310 | 215328 | C33 | 215711 | 215729 |

TABLE 4-continued

| Amplicon | SEQ ID No | Primer name | Position range of amplification primer in SEQ ID | | Primer name | Complementary position range of amplification primer in SEQ ID | |
|---|---|---|---|---|---|---|---|
| 8-126 | 1 | B34 | 216687 | 216704 | C34 | 217082 | 217101 |
| 8-130 | 1 | B35 | 216683 | 216702 | C35 | 217091 | 217109 |
| 99-5897 | 1 | B36 | 219408 | 219425 | C36 | 219882 | 219899 |
| 99-24649 | I | B37 | 220505 | 220522 | C37 | 221004 | 221021 |
| 8-247 | 1 | B38 | 223011 | 223028 | C38 | 223549 | 223566 |
| 8-246 | 1 | B39 | 223962 | 223978 | C39 | 224588 | 224605 |
| 8-245 | 1 | B40 | 224564 | 224581 | C40 | 225044 | 225061 |
| 8-119 | 1 | B41 | 230210 | 230227 | C41 | 230622 | 230641 |
| 99-15870 | 1 | B42 | 231278 | 231298 | C42 | 231729 | 231747 |
| 99-16087 | 1 | B43 | 235081 | 235101 | C43 | 235515 | 235533 |
| 8-155 | 1 | B44 | 238607 | 238626 | C44 | 239029 | 239046 |
| 99-16038 | 1 | B45 | 239405 | 239425 | C45 | 239862 | 239880 |
| 8-136 | 1 | B46 | 239606 | 239624 | C46 | 240012 | 240029 |
| 99-15880 | 1 | B47 | 241700 | 241717 | C47 | 242151 | 242171 |
| 8-271 | 1 | B48 | 243484 | 243502 | C48 | 243909 | 243926 |
| 8-267 | 1 | B49 | 245105 | 245123 | C49 | 245518 | 245535 |
| 8-266 | 1 | B50 | 245372 | 245389 | C50 | 245775 | 245793 |
| 8-265 | 1 | B51 | 245754 | 245772 | C51 | 246155 | 246173 |
| 99-25940 | 1 | B52 | 247513 | 247533 | C52 | 248023 | 248043 |
| 99-16032 | 1 | B53 | 248204 | 248223 | C53 | 248588 | 248606 |
| 99-16105 | 1 | B54 | 255697 | 255715 | C54 | 256133 | 256152 |
| 99-16033 | 1 | B55 | 259885 | 259902 | C55 | 260324 | 260342 |
| 99-15875 | 1 | B56 | 279626 | 279644 | C56 | 280154 | 280173 |
| 99-16052 | 1 | B57 | 300153 | 300170 | C57 | 300660 | 300680 |
| 99-16047 | 1 | B58 | 311615 | 311632 | C58 | 312126 | 312144 |
| 99-25993 | 1 | B59 | 315649 | 315668 | C59 | 316129 | 316147 |
| 8-102 | 24 | B60 | 1 | 20 | C60 | 408 | 427 |
| 8-104 | 25 | B61 | 1 | 21 | C61 | 295 | 310 |
| 8-94 | 26 | B62 | I | 18 | C62 | 400 | 418 |
| 8-95 | 27 | B63 | 1 | 18 | C63 | 400 | 419 |
| 8-97 | 28 | B64 | 1 | 18 | C64 | 331 | 350 |
| 8-98 | 29 | B65 | 1 | 19 | C65 | 415 | 434 |
| 99-14021 | 30 | B66 | 1 | 18 | C66 | 465 | 477 |
| 99-14364 | 31 | B67 | 64 | 82 | C67 | 434 | 454 |
| 99-15056 | 32 | B68 | 1 | 18 | C68 | 482 | 502 |
| 99-15229 | 33 | B69 | 1 | 20 | C69 | 476 | 494 |
| 99-15232 | 34 | B70 | 1 | 18 | C70 | 467 | 485 |
| 99-15253 | 35 | B71 | 1 | 19 | C71 | 459 | 477 |
| 99-15256 | 36 | B72 | 1 | 18 | C72 | 439 | 456 |
| 99-15258 | 37 | B73 | 1 | 19 | C73 | 521 | 541 |
| 99-15261 | 38 | B74 | 1 | 19 | C74 | 481 | 501 |
| 99-15280 | 39 | B75 | 1 | 18 | C75 | 521 | 541 |
| 99-15355 | 40 | B76 | 1 | 18 | C76 | 471 | 489 |
| 99-15663 | 41 | B77 | 1 | 18 | C77 | 430 | 450 |
| 99-15664 | 42 | B78 | 1 | 19 | C78 | 483 | 502 |
| 99-15665 | 43 | B79 | 1 | 20 | C79 | 458 | 476 |
| 99-15668 | 44 | B80 | 1 | 18 | C80 | 439 | 459 |
| 99-15672 | 45 | B81 | 1 | 18 | C81 | 533 | 547 |
| 99-15682 | 46 | B82 | 1 | 19 | C82 | 482 | 500 |
| 99-16081 | 47 | B83 | 1 | 18 | C83 | 443 | 462 |
| 99-16082 | 48 | B84 | 1 | 18 | C84 | 512 | 532 |
| 99-20933 | 49 | B85 | 1 | 19 | C85 | 432 | 451 |
| 99-20977 | 50 | B86 | 1 | 18 | C86 | 491 | 511 |
| 99-20978 | 51 | B87 | 1 | 19 | C87 | 446 | 466 |
| 99-20981 | 52 | B88 | 1 | 18 | C88 | 429 | 449 |
| 99-20983 | 53 | B89 | 1 | 19 | C89 | 431 | 449 |
| 99-22310 | 54 | B90 | 1 | 19 | C90 | 446 | 466 |
| 99-25922 | 55 | B91 | 1 | 21 | C91 | 451 | 471 |
| 99-25950 | 56 | B92 | 1 | 19 | C92 | 479 | 499 |
| 99-25961 | 57 | B93 | 1 | 20 | C93 | 464 | 484 |
| 99-25965 | 58 | B94 | 1 | 21 | C94 | 451 | 470 |
| 99-25966 | 59 | B95 | 1 | 21 | C95 | 503 | 523 |
| 99-25967 | 60 | B96 | 1 | 20 | C96 | 473 | 493 |
| 99-25969 | 61 | B97 | 1 | 21 | C97 | 510 | 530 |
| 99-25972 | 62 | B98 | 1 | 21 | C98 | 428 | 448 |
| 99-25974 | 63 | B99 | 1 | 21 | C99 | 524 | 544 |
| 99-25977 | 64 | B100 | 1 | 21 | C100 | 520 | 540 |
| 99-25979 | 65 | B101 | 1 | 19 | C101 | 518 | 538 |
| 99-25985 | 66 | B102 | 1 | 21 | C102 | 449 | 469 |
| 99-25989 | 67 | B103 | 1 | 19 | C103 | 533 | 553 |
| 99-26146 | 68 | B104 | 1 | 19 | C104 | 436 | 456 |
| 99-26150 | 69 | B105 | 1 | 19 | C105 | 437 | 454 |
| 99-26153 | 70 | B106 | 1 | 19 | C106 | 429 | 449 |
| 99-26156 | 71 | B107 | 1 | 18 | C107 | 491 | 511 |

TABLE 4-continued

| Amplicon | SEQ ID No | Primer name | Position range of amplification primer in SEQ ID | | Primer name | Complementary position range of amplification primer in SEQ ID | |
|---|---|---|---|---|---|---|---|
| 99-27345 | 72 | B108 | 1 | 18 | C108 | 531 | 551 |
| 99-30329 | 73 | B109 | 1 | 18 | C109 | 496 | 514 |
| 99-31798 | 74 | B110 | 1 | 20 | C110 | 491 | 511 |
| 99-5873 | 75 | B111 | 11 | 28 | C111 | 466 | 474 |
| 99-6012 | 76 | B112 | 11 | 29 | C112 | 477 | 490 |
| 99-6080 | 77 | B113 | 11 | 28 | C113 | 519 | 529 |
| 99-7308 | 78 | B114 | 1 | 18 | C114 | 469 | 489 |

Preferably, the primers contained a common oligonucleotide tail upstream of the specific bases targeted for amplification which was useful for sequencing.

Primers from the column labeled "Position range of amplification primer in SEQ ID No." contain the following additional PU 5' sequence: TGTAAAACGACGGCCAGT (SEQ ID No. 133); primers from the column labeled "Complementary position range of amplification primer in SEQ ID No." contain the following RP 5' sequence: CAGGAAACAGCTATGACC (SEQ ID No. 134).

The synthesis of these primers was performed following the phosphoramidite method, on a GENSET UFPS 24.1 synthesizer.

DNA amplification was performed on a Genius II thermocycler. After heating at 95° C. for 10 min, 40 cycles were performed. Each cycle comprised: 30 sec at 95° C., 54° C. for 1 min, and 30 sec at 72° C. For final elongation, 10 min at 72° C. ended the amplification. The quantities of the amplification products obtained were determined on 96-well microtiter plates, using a fluorometer and Picogreen as intercalant agent (Molecular Probes).

Example 3

Identification of Polymorphisms a) Identification of Biallelic Markers from Amplified Genomic DNA of Example 2

The sequencing of the amplified DNA obtained in Example 2 was carried out on ABI 377 sequencers. The sequences of the amplification products were determined using automated dideoxy terminator sequencing reactions with a dye terminator cycle sequencing protocol. The products of the sequencing reactions were run on sequencing gels and the sequences were determined using gel image analysis (ABI Prism DNA Sequencing Analysis software (2.1.2 version)).

The sequence data were further evaluated to detect the presence of biallelic markers within the amplified fragments. The polymorphism search was based on the presence of superimposed peaks in the electrophoresis pattern resulting from different bases occurring at the same position as described previously.

The localization of the biallelic markers detected in the fragments of amplification are as shown below in Table 5.

TABLE 5

Biallelic Markers

| Amplicon | BM | Marker Name | Polymorphism A111 | A112 | SEQ ID No. | BM position in SEQID | Position of probes in SEQ ID No. | | | Probe No. |
|---|---|---|---|---|---|---|---|---|---|---|
| 99-27943 | A1 | 99-27943-150 | G | C | 1 | 8316 | 8304 | 8328 | P1 |
| 99-27935 | A2 | 99-27935-193 | G | C | 1 | 21672 | 21660 | 21684 | P2 |
| 8-128 | A3 | 8-128-33 | C | T | 1 | 65485 | 65473 | 65497 | P3 |
| 99-31960 | A4 | 99-31960-363 | A | G | 1 | 95396 | 95384 | 95408 | P4 |
| 99-24656 | A5 | 99-24656-260 | A | G | 1 | 107281 | 107269 | 107293 | P5 |
| 99-24634 | A6 | 99-24639-163 | A | C | 1 | 160640 | 160628 | 160652 | P6 |
| 99-24639 | A7 | 99-24634-108 | A | T | 1 | 160876 | 160864 | 160888 | P7 |
| 99-7652 | A8 | 99-7652-162 | A | G | 1 | 168974 | 168962 | 168986 | P8 |
| 99-16100 | A9 | 99-16100-147 | A | G | 1 | 170810 | 170798 | 170822 | P9 |
| 99-5862 | A10 | 99-5862-167 | A | G | 1 | 173358 | 173346 | 173370 | P10 |
| 99-5919 | A11 | 99-5919-215 | A | G | 1 | 189957 | 189945 | 189969 | P11 |
| 99-24658 | A12 | 99-24658-410 | A | G | 1 | 197163 | 197151 | 197175 | P12 |
| 8-303 | A13 | 8-303-235 | A | G | 1 | 200778 | 200766 | 200790 | P13 |
| 8-300 | A14 | 8-300-221 | A | G | 1 | 202651 | 202639 | 202663 | P14 |
| 8-300 | A15 | 8-300-193 | A | G | 1 | 202679 | 202667 | 202691 | P15 |
| 8-299 | A16 | 8-299-128 | A | T | 1 | 203378 | 203366 | 203390 | P16 |
| 8-296 | A17 | 8-296-213 | A | T | 1 | 204138 | 204126 | 204150 | P17 |
| 8-252 | A18 | 8-252-190 | C | T | 1 | 204605 | 204593 | 204617 | P18 |
| 99-24644 | A19 | 99-24644-194 | A | G | 1 | 204934 | 204922 | 204946 | P19 |
| 8-295 | A20 | 8-295-248 | A | C | 1 | 205206 | 205194 | 205218 | P20 |
| 8-295 | A21 | 8-295-125 | C | T | 1 | 205329 | 205317 | 205341 | P21 |
| 8-293 | A22 | 8-293-130 | A | G | 1 | 206064 | 206052 | 206076 | P22 |
| 8-292 | A23 | 8-292-198 | A | G | 1 | 206545 | 206533 | 206557 | P23 |
| 8-251 | A24 | 8-251-322 | A | G | 1 | 207313 | 207301 | 207325 | P24 |
| 8-289 | A25 | 8-289-322 | A | G | 1 | 208285 | 208273 | 208297 | P25 |
| 8-287 | A26 | 8-287-249 | C | T | 1 | 208960 | 208948 | 208972 | P26 |

TABLE 5-continued

Biallelic Markers

| Amplicon | BM | Marker Name | Polymorphism A111 | Polymorphism A112 | SEQ ID No. | BM position in SEQID | Position of probes in SEQ ID No. | | Probe No. |
|---|---|---|---|---|---|---|---|---|---|
| 8-287 | A27 | 8-287-86 | A | T | 1 | 209123 | 209111 | 209135 | P27 |
| 8-285 | A28 | 8-285-319 | A | G | 1 | 209631 | 209619 | 209643 | P28 |
| 8-283 | A29 | 8-283-278 | G | C | 1 | 210361 | 210349 | 210373 | P29 |
| 8-283 | A30 | 8-283-176 | A | G | 1 | 210463 | 210451 | 210475 | P30 |
| 8-283 | A31 | 8-283-153 | G | C | 1 | 210486 | 210474 | 210498 | P31 |
| 8-283 | A32 | 8-283-56 | C | T | 1 | 210583 | 210571 | 210595 | P32 |
| 8-282 | A33 | 8-282-345 | G | C | 1 | 210879 | 210867 | 210891 | P33 |
| 8-282 | A34 | 8-282-260 | G | T | 1 | 210964 | 210952 | 210976 | P34 |
| 8-282 | A35 | 8-282-245 | A | C | 1 | 210979 | 210967 | 210991 | P35 |
| 8-282 | A36 | 8-282-174 | Variable motif | | 1 | 211050 | | | P36 |
| 8-282 | A37 | 8-282-92 | A | T | 1 | 211132 | 211120 | 211144 | P37 |
| 8-281 | A38 | 8-281-367 | A | G | 1 | 211247 | 211235 | 211259 | P38 |
| 8-281 | A39 | 8-281-299 | A | G | 1 | 211315 | 211303 | 211327 | P39 |
| 8-281 | A40 | 8-281-248 | G | C | 1 | 211366 | 211354 | 211378 | P40 |
| 8-279 | A41 | 8-279-197 | A | C | 1 | 212520 | 212508 | 212532 | P41 |
| 8-278 | A42 | 8-278-289 | C | T | 1 | 212821 | 212809 | 212833 | P42 |
| 8-277 | A43 | 8-277-250 | C | T | 1 | 213833 | 213821 | 213845 | P43 |
| 8-124 | A44 | 8-124-294 | A | G | 1 | 214857 | 214845 | 214869 | P44 |
| 8-273 | A45 | 8-273-383 | A | G | 1 | 215347 | 215335 | 215359 | P45 |
| 8-130/ 8-126 | A46 | 8-130-143/ 8-126-286 | A | G | 1 | 216967 | 216955 | 216979 | P46 |
| 99-5897 | A47 | 99-5897-143 | A | C | 1 | 219540 | 219528 | 219552 | P47 |
| 99-24649 | A48 | 99-24649-186 | A | G | 1 | 220836 | 220824 | 220848 | P48 |
| 8-247 | A49 | 8-247-337 | A | G | 1 | 223230 | 223218 | 223242 | P49 |
| 8-246 | A50 | 8-246-393 | A | T | 1 | 224213 | 224201 | 224225 | P50 |
| 8-245 | A51 | 8-245-270 | A | G | 1 | 224792 | 224780 | 224804 | P51 |
| 8-119 | A52 | 8-119-247 | A | G | 1 | 230395 | 230383 | 230407 | P52 |
| 99-15870 | A53 | 99-15870-400 | A | G | 1 | 231677 | 231665 | 231689 | P53 |
| 99-16087 | A54 | 99-16087-219 | G | C | 1 | 235315 | 235303 | 235327 | P54 |
| 8-155 | A55 | 8-155-258 | C | T | 1 | 238789 | 238777 | 238801 | P55 |
| 99-16038 | A56 | 99-16038-118 | C | T | 1 | 239763 | 239751 | 239775 | P56 |
| 8-136 | A57 | 8-136-267 | C | T | 1 | 239763 | 239751 | 239775 | P57 |
| 99-15880 | A58 | 99-15880-162 | A | G | 1 | 241861 | 241849 | 241873 | P58 |
| 8-271 | A59 | 8-271-227 | A | G | 1 | 243700 | 243688 | 243712 | P59 |
| 8-267 | A60 | 8-267-273 | Deletion | | 1 | 245263 | | | P60 |
| 8-266 | A61 | 8-266-131 | A | C | 1 | 245663 | 245651 | 245675 | P61 |
| 8-265 | A62 | 8-265-208 | A | G | 1 | 245966 | 245954 | 245978 | P62 |
| 8-265 | A63 | 8-265-203 | G | C | 1 | 245971 | 245959 | 245983 | P63 |
| 99-25940 | A64 | 99-25940-182 | C | T | 1 | 247864 | 247852 | 247876 | P64 |
| 99-16032 | A65 | 99-16032-292 | G | T | 1 | 248315 | 248303 | 248327 | P65 |
| 99-16105 | A66 | 99-16105-152 | A | G | 1 | 255848 | 255836 | 255860 | P66 |
| 99-16033 | A67 | 99-16033-244 | A | G | 1 | 260099 | 260087 | 260111 | P67 |
| 99-15875 | A68 | 99-15875-165 | C | T | 1 | 279789 | 279777 | 279801 | P68 |
| 99-16052 | A69 | 99-16052-214 | A | G | 1 | 300365 | 300353 | 300377 | P69 |
| 99-16047 | A70 | 99-16047-115 | A | G | 1 | 312030 | 312018 | 312042 | P70 |
| 99-25993 | A71 | 99-25993-367 | A | G | 1 | 316014 | 316002 | 316026 | P71 |
| 8-102 | A72 | 8-102-231 | C | T | 24 | 231 | 219 | 243 | P72 |
| 8-104 | A73 | 8-104-105 | A | G | 25 | 105 | 93 | 117 | P73 |
| 8-94 | A74 | 8-94-252 | A | G | 26 | 251 | 239 | 263 | P74 |
| 8-95 | A75 | 8-95-43 | A | G | 27 | 43 | 31 | 55 | P75 |
| 8-97 | A76 | 8-97-181 | A | G | 28 | 181 | 169 | 193 | P76 |
| 8-97 | A77 | 8-97-98 | C | T | 28 | 98 | 86 | 110 | P77 |
| 8-98 | A78 | 8-98-68 | A | G | 29 | 68 | 56 | 80 | P78 |
| 99-14021 | A79 | 99-14021-108 | A | G | 30 | 108 | 96 | 120 | P79 |
| 99-14364 | A80 | 99-14364-415 | C | T | 31 | 415 | 403 | 427 | P80 |
| 99-15056 | A81 | 99-15056-99 | C | T | 32 | 99 | 87 | 111 | P81 |
| 99-15229 | A82 | 99-15229-412 | A | G | 33 | 412 | 400 | 424 | P82 |
| 99-15232 | A83 | 99-15232-291 | G | T | 34 | 291 | 279 | 303 | P83 |
| 99-15253 | A84 | 99-15253-382 | C | T | 35 | 382 | 370 | 394 | P84 |
| 99-15256 | A85 | 99-15256-392 | C | T | 36 | 392 | 380 | 404 | P85 |
| 99-15258 | A86 | 99-15258-337 | G | T | 37 | 337 | 325 | 349 | P86 |
| 99-15261 | A87 | 99-15261-202 | A | G | 38 | 200 | 188 | 212 | P87 |
| 99-15280 | A88 | 99-15280-432 | C | T | 39 | 432 | 420 | 444 | P88 |
| 99-15355 | A89 | 99-15355-150 | C | T | 40 | 150 | 138 | 162 | P89 |
| 99-15663 | A90 | 99-15663-298 | C | T | 41 | 298 | 286 | 310 | P90 |
| 99-15664 | A91 | 99-15664-185 | G | T | 42 | 185 | 173 | 197 | P91 |
| 99-15665 | A92 | 99-15665-398 | A | G | 43 | 398 | 386 | 410 | P92 |
| 99-15668 | A93 | 99-15668-139 | C | T | 44 | 139 | 127 | 151 | P93 |
| 99-15672 | A94 | 99-15672-166 | C | T | 45 | 166 | 154 | 178 | P94 |
| 99-15682 | A95 | 99-15682-318 | A | T | 46 | 318 | 306 | 330 | P95 |
| 99-16081 | A96 | 99-16081-217 | C | T | 47 | 217 | 205 | 229 | P96 |

TABLE 5-continued

Biallelic Markers

| Amplicon | BM | Marker Name | Polymorphism A111 | Polymorphism A112 | SEQ ID No. | BM position in SEQID | Position of probes in SEQ ID No. | | Probe No. |
|---|---|---|---|---|---|---|---|---|---|
| 99-16082 | A97 | 99-16082-218 | A | G | 48 | 218 | 206 | 230 | P97 |
| 99-20933 | A98 | 99-20933-81 | A | C | 49 | 81 | 69 | 93 | P98 |
| 99-20977 | A99 | 99-20977-72 | A | C | 50 | 71 | 59 | 83 | P99 |
| 99-20978 | A100 | 99-20978-89 | G | C | 51 | 89 | 77 | 101 | P100 |
| 99-20981 | A101 | 99-20981-300 | A | G | 52 | 300 | 288 | 312 | P101 |
| 99-20983 | A102 | 99-20983-48 | A | G | 53 | 48 | 36 | 60 | P102 |
| 99-22310 | A103 | 99-22310-148 | C | T | 54 | 148 | 136 | 160 | P103 |
| 99-25922 | A104 | 99-25922-147 | G | T | 55 | 147 | 135 | 159 | P104 |
| 99-25950 | A105 | 99-25950-121 | G | C | 56 | 121 | 109 | 133 | P105 |
| 99-25961 | A106 | 99-25961-376 | A | C | 57 | 373 | 361 | 385 | P106 |
| 99-25965 | A107 | 99-25965-399 | A | G | 58 | 399 | 387 | 411 | P107 |
| 99-25966 | A108 | 99-25966-241 | A | G | 59 | 241 | 229 | 253 | P108 |
| 99-25967 | A109 | 99-25967-57 | A | G | 60 | 56 | 44 | 68 | P109 |
| 99-25969 | A110 | 99-25969-200 | G | T | 61 | 200 | 188 | 212 | P110 |
| 99-25972 | A111 | 99-25972-317 | C | T | 62 | 315 | 303 | 327 | P111 |
| 99-25974 | A112 | 99-25974-143 | A | G | 63 | 143 | 131 | 155 | P112 |
| 99-25977 | A113 | 99-25977-311 | A | G | 64 | 311 | 299 | 323 | P113 |
| 99-25979 | A114 | 99-25979-93 | A | G | 65 | 93 | 81 | 105 | P114 |
| 99-25985 | A115 | 99-25985-194 | C | T | 66 | 194 | 182 | 206 | P115 |
| 99-25989 | A116 | 99-25989-398 | A | G | 67 | 398 | 386 | 410 | P116 |
| 99-26146 | A117 | 99-26146-264 | G | T | 68 | 264 | 252 | 276 | P117 |
| 99-26150 | A118 | 99-26150-276 | A | G | 69 | 276 | 264 | 288 | P118 |
| 99-26153 | A119 | 99-26153-44 | A | C | 70 | 44 | 32 | 56 | P119 |
| 99-26156 | A120 | 99-26156-290 | A | C | 71 | 290 | 278 | 302 | P120 |
| 99-27345 | A121 | 99-27345-189 | G | C | 72 | 189 | 177 | 201 | P121 |
| 99-30329 | A122 | 99-30329-380 | C | T | 73 | 380 | 368 | 392 | P122 |
| 99-31798 | A123 | 99-31798-344 | Variable motif | | 74 | 342 | | | P123 |
| 99-5873 | A124 | 99-5873-159 | C | T | 75 | 159 | 147 | 171 | P124 |
| 99-6012 | A125 | 99-6012-220 | G | T | 76 | 220 | 208 | 232 | P125 |
| 99-6080 | A126 | 99-6080-99 | C | T | 77 | 99 | 87 | 111 | P126 |
| 99-7308 | A127 | 99-7308-157 | C | T | 78 | 156 | 144 | 168 | P127 |

BM refers to "biallelic marker". A111 and a112 refer respectively to allele 1 and allele 2 of the biallelic marker.

Certain biallelic markers of the invention are insertions or deletions, as indicated above. In particular, the biallelic marker 8-282-174 comprises a variable motif AAAGG or GAAGGAAGGAAGGAAGGAAGA. The biallelic marker 8-267-273 comprises an insertion or deletion of GTGGGC. The biallelic marker 99-31798-344 comprises a variable motif CAT or ACTGTCTCTACCTCA

Example 4

Validation of the Polymorphisms through Microsequencing

The biallelic markers identified in Example 3 were further confirmed and their respective frequencies were determined through microsequencing. Microsequencing was carried out for each individual DNA sample described in Example 1.

Amplification from genomic DNA of individuals was performed by PCR as described above for the detection of the biallelic markers with the same set of PCR primers (Table 3).

The preferred primers used in microsequencing were about 19 nucleotides in length and hybridized just upstream of the considered polymorphic base. According to the invention, the primers used in microsequencing are detailed in Table 6.

TABLE 6

| Marker Name | Biallelic Marker | SEQ ID No. | Mis. 1 | Position range of microsequencing primer mis. 1 in SEQ ID No. | | Mis. 2 | Complementary position range of microsequencing primer mis. 2 in SEQ ID No. | |
|---|---|---|---|---|---|---|---|---|
| 99-27943-150 | A1 | 1 | D1 | 8297 | 8315 | E1 | 8317 | 8335 |
| 99-27935-193 | A2 | 1 | D2 | 21653 | 21671 | E2 | 21673 | 21691 |
| 8-128-33 | A3 | 1 | D3 | 65466 | 65484 | E3 | 65486 | 65504 |
| 99-31960-363 | A4 | 1 | D4 | 95377 | 95395 | E4 | 95397 | 95415 |
| 99-24656-260 | A5 | 1 | D5 | 107262 | 107280 | E5 | 107282 | 107300 |
| 99-24639-163 | A6 | 1 | D6 | 160621 | 160639 | E6 | 160641 | 160659 |

TABLE 6-continued

| Marker Name | Biallelic Marker | SEQ ID No. | Mis. 1 | Position range of microsequencing primer mis. 1 in SEQ ID No. | | Mis. 2 | Complementary position range of microsequencing primer mis. 2 in SEQ ID No. | |
|---|---|---|---|---|---|---|---|---|
| 99-24634-108 | A7 | 1 | D7 | 160857 | 160875 | E7 | 160877 | 160895 |
| 99-7652-162 | A8 | 1 | D8 | 168955 | 168973 | E8 | 168975 | 168993 |
| 99-16100-147 | A9 | 1 | D9 | 170791 | 170809 | E9 | 170811 | 170829 |
| 99-5862-167 | A10 | 1 | D10 | 173339 | 173357 | E10 | 173359 | 173377 |
| 99-5919-215 | A11 | 1 | D11 | 189938 | 189956 | E11 | 189958 | 189976 |
| 99-24658-410 | A12 | 1 | D12 | 197144 | 197162 | E12 | 197164 | 197182 |
| 8-303-235 | A13 | 1 | D13 | 200759 | 200777 | E13 | 200779 | 200797 |
| 8-300-221 | A14 | 1 | D14 | 202632 | 202650 | E14 | 202652 | 202670 |
| 8-300-193 | A15 | 1 | D15 | 202660 | 202678 | E15 | 202680 | 202698 |
| 8-299-128 | A16 | 1 | D16 | 203359 | 203377 | E16 | 203379 | 203397 |
| 8-296-213 | A17 | 1 | D17 | 204119 | 204137 | E17 | 204139 | 204157 |
| 8-252-190 | A18 | 1 | D18 | 204586 | 204604 | E18 | 204606 | 204624 |
| 99-24644-194 | A19 | 1 | D19 | 204915 | 204933 | E19 | 204935 | 204953 |
| 8-295-248 | A20 | 1 | D20 | 205187 | 205205 | E20 | 205207 | 205225 |
| 8-295-125 | A21 | 1 | D21 | 205310 | 205328 | E21 | 205330 | 205348 |
| 8-293-130 | A22 | 1 | D22 | 206045 | 206063 | E22 | 206065 | 206083 |
| 8-292-198 | A23 | 1 | D23 | 206526 | 206544 | E23 | 206546 | 206564 |
| 8-251-322 | A24 | 1 | D24 | 207294 | 207312 | E24 | 207314 | 207332 |
| 8-289-322 | A25 | 1 | D25 | 208266 | 208284 | E25 | 208286 | 208304 |
| 8-287-249 | A26 | 1 | D26 | 208941 | 208959 | E26 | 208961 | 208979 |
| 8-287-86 | A27 | 1 | D27 | 209104 | 209122 | E27 | 209124 | 209142 |
| 8-285-319 | A28 | 1 | D28 | 209612 | 209630 | E28 | 209632 | 209650 |
| 8-283-278 | A29 | 1 | D29 | 210342 | 210360 | E29 | 210362 | 210380 |
| 8-283-176 | A30 | 1 | D30 | 210444 | 210462 | E30 | 210464 | 210482 |
| 8-283-153 | A31 | 1 | D31 | 210467 | 210485 | E31 | 210487 | 210505 |
| 8-283-56 | A32 | 1 | D32 | 210564 | 210582 | E32 | 210584 | 210602 |
| 8-282-345 | A33 | 1 | D33 | 210860 | 210878 | E33 | 210880 | 210898 |
| 8-282-260 | A34 | 1 | D34 | 210945 | 210963 | E34 | 210965 | 210983 |
| 8-282-245 | A35 | 1 | D35 | 210960 | 210978 | E35 | 210980 | 210998 |
| 8-282-174 | A36 | 1 | D36 | | | E36 | | |
| 8-282-92 | A37 | 1 | D37 | 211113 | 211131 | E37 | 211133 | 211151 |
| 8-281-367 | A38 | 1 | D38 | 211228 | 211246 | E38 | 211248 | 211266 |
| 8-281-299 | A39 | 1 | D39 | 211296 | 211314 | E39 | 211316 | 211334 |
| 8-281-248 | A40 | 1 | D40 | 211347 | 211365 | E40 | 211367 | 211385 |
| 8-279-197 | A41 | 1 | D41 | 212501 | 212519 | E41 | 212521 | 212539 |
| 8-278-289 | A42 | 1 | D42 | 212802 | 212820 | E42 | 212822 | 212840 |
| 8-277-250 | A43 | 1 | D43 | 213814 | 213832 | E43 | 213834 | 213852 |
| 8-124-294 | A44 | 1 | D44 | 214838 | 214856 | E44 | 214858 | 214876 |
| 8-273-383 | A45 | 1 | D45 | 215328 | 215346 | E45 | 215348 | 215366 |
| 8-130-143/ 8-126-286 | A46 | 1 | D46 | 216948 | 216966 | E46 | 216968 | 216986 |
| 99-5897-143 | A47 | 1 | D47 | 219521 | 219539 | E47 | 219541 | 219559 |
| 99-24649-186 | A48 | 1 | D48 | 220817 | 220835 | E48 | 220837 | 220855 |
| 8-247-337 | A49 | 1 | D49 | 223211 | 223229 | E49 | 223231 | 223249 |
| 8-246-393 | A50 | 1 | D50 | 224194 | 224212 | E50 | 224214 | 224232 |
| 8-245-270 | A51 | 1 | D51 | 224773 | 224791 | E51 | 224793 | 224811 |
| 8-119-247 | A52 | 1 | D52 | 230376 | 230394 | E52 | 230396 | 230414 |
| 99-15870-400 | A53 | 1 | D53 | 231658 | 231676 | E53 | 231678 | 231696 |
| 99-16087-219 | A54 | 1 | D54 | 235296 | 235314 | E54 | 235316 | 235334 |
| 8-155-258 | A55 | 1 | D55 | 238770 | 238788 | E55 | 238790 | 238808 |
| 99-16038-118 | A56 | 1 | D56 | 239744 | 239762 | E56 | 239764 | 239782 |
| 8-136-267 | A57 | 1 | D57 | 239744 | 239762 | E57 | 239764 | 239782 |
| 99-15880-162 | A58 | 1 | D58 | 241842 | 241860 | E58 | 241862 | 241880 |
| 8-271-227 | A59 | 1 | D59 | 243681 | 243699 | E59 | 243701 | 243719 |
| 8-267-273 | A60 | 1 | D60 | | | E60 | | |
| 8-266-131 | A61 | 1 | D61 | 245644 | 245662 | E61 | 245664 | 245682 |
| 8-265-208 | A62 | 1 | D62 | 245947 | 245965 | E62 | 245967 | 245985 |
| 8-265-203 | A63 | 1 | D63 | 245952 | 245970 | E63 | 245972 | 245990 |
| 99-25940-182 | A64 | 1 | D64 | 247845 | 247863 | E64 | 247865 | 247883 |
| 99-16032-292 | A65 | 1 | D65 | 248296 | 248314 | E65 | 248316 | 248334 |
| 99-16105-152 | A66 | 1 | D66 | 255829 | 255847 | E66 | 255849 | 255867 |
| 99-16033-244 | A67 | 1 | D67 | 260080 | 260098 | E67 | 260100 | 260118 |
| 99-15875-165 | A68 | 1 | D68 | 279770 | 279788 | E68 | 279790 | 279808 |
| 99-16052-214 | A69 | 1 | D69 | 300346 | 300364 | E69 | 300366 | 300384 |
| 99-16047-115 | A70 | 1 | D70 | 312011 | 312029 | E70 | 312031 | 312049 |
| 99-25993-367 | A71 | 1 | D71 | 315995 | 316013 | E71 | 316015 | 316033 |
| 8-102-231 | A72 | 24 | D72 | 212 | 230 | E72 | 232 | 250 |
| 8-104-105 | A73 | 25 | D73 | 86 | 104 | E73 | 106 | 124 |
| 8-94-252 | A74 | 26 | D74 | 232 | 250 | E74 | 252 | 270 |
| 8-95-43 | A75 | 27 | D75 | 24 | 42 | E75 | 44 | 62 |
| 8-97-181 | A76 | 28 | D76 | 162 | 180 | E76 | 182 | 200 |
| 8-97-98 | A77 | 28 | D77 | 79 | 97 | E77 | 99 | 117 |
| 8-98-68 | A78 | 29 | D78 | 49 | 67 | E78 | 69 | 87 |

TABLE 6-continued

| Marker Name | Biallelic Marker | SEQ ID No. | Mis. 1 | Position range of microsequencing primer mis. 1 in SEQ ID No. | | Mis. 2 | Complementary position range of microsequencing primer mis. 2 in SEQ ID No. | |
|---|---|---|---|---|---|---|---|---|
| 99-14021-108 | A79 | 30 | D79 | 89 | 107 | E79 | 109 | 127 |
| 99-14364-415 | A80 | 31 | D80 | 396 | 414 | E80 | 416 | 434 |
| 99-15056-99 | A81 | 32 | D81 | 80 | 98 | E81 | 100 | 118 |
| 99-15229-412 | A82 | 33 | D82 | 393 | 411 | E82 | 413 | 431 |
| 99-15232-291 | A83 | 34 | D83 | 272 | 290 | E83 | 292 | 310 |
| 99-15253-382 | A84 | 35 | D84 | 363 | 381 | E84 | 383 | 401 |
| 99-15256-392 | A85 | 36 | D85 | 373 | 391 | E85 | 393 | 411 |
| 99-15258-337 | A86 | 37 | D86 | 318 | 336 | E86 | 338 | 356 |
| 99-15261-202 | A87 | 38 | D87 | 181 | 199 | E87 | 201 | 219 |
| 99-15280-432 | A88 | 39 | D88 | 413 | 431 | E88 | 433 | 451 |
| 99-15355-150 | A89 | 40 | D89 | 131 | 149 | E89 | 151 | 169 |
| 99-15663-298 | A90 | 41 | D90 | 279 | 297 | E90 | 299 | 317 |
| 99-15664-185 | A91 | 42 | D91 | 166 | 184 | E91 | 186 | 204 |
| 99-15665-398 | A92 | 43 | D92 | 379 | 397 | E92 | 399 | 417 |
| 99-15668-139 | A93 | 44 | D93 | 120 | 138 | E93 | 140 | 158 |
| 99-15672-166 | A94 | 45 | D94 | 147 | 165 | E94 | 167 | 185 |
| 99-15682-318 | A95 | 46 | D95 | 299 | 317 | E95 | 319 | 337 |
| 99-16081-217 | A96 | 47 | D96 | 198 | 216 | E96 | 218 | 236 |
| 99-16082-218 | A97 | 48 | D97 | 199 | 217 | E97 | 219 | 237 |
| 99-20933-81 | A98 | 49 | D98 | 62 | 80 | E98 | 82 | 100 |
| 99-20977-72 | A99 | 50 | D99 | 52 | 70 | E99 | 72 | 90 |
| 99-20978-89 | A100 | 51 | D100 | 70 | 88 | E100 | 90 | 108 |
| 99-20981-300 | A101 | 52 | D101 | 281 | 299 | E101 | 301 | 319 |
| 99-20983-48 | A102 | 53 | D102 | 29 | 47 | E102 | 49 | 67 |
| 99-22310-148 | A103 | 54 | D103 | 129 | 147 | E103 | 149 | 167 |
| 99-25922-147 | A104 | 55 | D104 | 128 | 146 | E104 | 148 | 166 |
| 99-25950-121 | A105 | 56 | D105 | 102 | 120 | E105 | 122 | 140 |
| 99-15961-376 | A106 | 57 | D106 | 354 | 372 | E106 | 374 | 392 |
| 99-25965-399 | A107 | 58 | D107 | 380 | 398 | E107 | 400 | 418 |
| 99-25966-241 | A108 | 59 | D108 | 222 | 240 | E108 | 242 | 260 |
| 99-25967-57 | A109 | 60 | D109 | 37 | 55 | E109 | 57 | 75 |
| 99-25969-200 | A110 | 61 | D110 | 181 | 199 | E110 | 201 | 219 |
| 99-25972-317 | A111 | 62 | D111 | 296 | 314 | E111 | 316 | 334 |
| 99-25974-143 | A112 | 63 | D112 | 124 | 142 | E112 | 144 | 162 |
| 99-25977-311 | A113 | 64 | D113 | 292 | 310 | E113 | 312 | 330 |
| 99-25979-93 | A114 | 65 | D114 | 74 | 92 | E114 | 94 | 112 |
| 99-25985-194 | A115 | 66 | D115 | 175 | 193 | E115 | 195 | 213 |
| 99-25989-398 | A116 | 67 | D116 | 379 | 397 | E116 | 399 | 417 |
| 99-26146-264 | A117 | 68 | D117 | 245 | 263 | E117 | 265 | 283 |
| 99-26150-276 | A118 | 69 | D118 | 257 | 275 | E118 | 277 | 295 |
| 99-26153-44 | A119 | 70 | D119 | 25 | 43 | E119 | 45 | 63 |
| 99-26156-290 | A120 | 71 | D120 | 271 | 289 | E120 | 291 | 309 |
| 99-27345-189 | A121 | 72 | D121 | 170 | 188 | E121 | 190 | 208 |
| 99-30329-380 | A122 | 73 | D122 | 361 | 379 | E122 | 381 | 399 |
| 99-31798-344 | A123 | 74 | D123 | | | E123 | | |
| 99-5873-159 | A124 | 75 | D124 | 140 | 158 | E124 | 160 | 178 |
| 99-6012-220 | A125 | 76 | D125 | 201 | 219 | E125 | 221 | 239 |
| 99-6080-99 | A126 | 77 | D126 | 80 | 98 | E126 | 100 | 118 |
| 99-7308-157 | A127 | 78 | D127 | 137 | 155 | E127 | 157 | 175 |

Mis 1 and Mis 2 respectively refer to microsequencing primers which hybridized with the coding strand or with the non-coding strand of the nuceotide sequences of the invention.

The microsequencing reaction was performed as follows:

After purification of the amplification products, the microsequencing reaction mixture was prepared by adding, in a 20 μl final volume: 10 pmol microsequencing oligonucleotide, 1 U Thermosequenase (Amersham E79000G), 1.25 μl Thermosequenase buffer (260 mM Tris HCl pH 9.5, 65 mM MgCl$_2$), and the two appropriate fluorescent ddNTPs (Perkin Elmer, Dye Terminator Set 401095) complementary to the nucleotides at the polymorphic site of each biallelic marker tested, following the manufacturer's recommendations. After 4 minutes at 94° C., 20 PCR cycles of 15 sec at 55° C., 5 sec at 72° C., and 10 sec at 94° C. were carried out in a Tetrad PTC-225 thermocycler (MJ Research). The unincorporated dye terminators were then removed by ethanol precipitation. Samples were finally resuspended in formamide-EDTA loading buffer and heated for 2 min at 95° C. before being loaded on a polyacrylamide sequencing gel. The data were collected by an ABI PRISM 377 DNA sequencer and processed using the GENESCAN software (Perkin Elmer).

Following gel analysis, data were automatically processed with software that allows the determination of the alleles of biallelic markers present in each amplified fragment.

The software evaluates such factors as whether the intensities of the signals resulting from the above microsequencing procedures are weak, normal, or saturated, or whether the signals are ambiguous. In addition, the software identifies significant peaks (according to shape and height criteria). Among the significant peaks, peaks corresponding to the targeted site are identified based on their position. When two significant peaks are detected for the same position, each sample is categorized classification as homozygous or heterozygous type based on the height ratio.

Example 5a

Association Study Between Schizophrenia and the Biallelic Markers of the Invention Collection of DNA Samples from Affected and Non-affected Individuals A) Affected Population All the samples were collected from a large epidemiological study of schizophrenia undertaken in hospital centers of Quebec from October 1995 to April 1997. The population was composed of French Caucasian individuals. The study design consisted in the ascertainment of cases and two of their first degree relatives (parents or siblings).

As a whole, 956 schizophrenic cases were ascertained according to the following inclusion criteria:

the diagnosis had been done by a psychiatrist;

the diagnosis had been done at least 3 years before recruitment time, in order to exclude individuals suffering from transient manic-depressive psychosis or depressive disorders;

the patient ancestors had been living in Quebec for at least 6 generations;

it was possible to get a blood sample from 2 close relatives.

Among the 956 schizophrenic ascertained cases, 834 individuals were included in the study for the following reasons:

for the included individual cases, the diagnosis of schizophrenia was established according to the DSM-IV (Diagnostic and Statistical Manual, Fourth edition, Revised 1994, American Psychiatric Press);

samples from individuals suffering from schizoaffective disorder were discarded;

individuals suffering from catatonic schizophrenia were also excluded from the population of schizophrenic cases;

were also excluded the individuals having a first degree relative or 2 or more second degree relatives suffering from depression or mood disorder;

individuals having had severe head trauma, severe obstretical complications, encephalitis, or meningitis before onset of symptoms were also excluded;

has also been excluded from the population of schizophrenic cases a patient suffering from epilepsy and treated with anticonvulsants.

The age at onset was not added as an inclusion criteria.

B) Unaffected Population

Control cases were respectively ascertained based on the following cumulative criteria:

the individual must not be affected by schizophrenia or any other psychiatric disorder;

the individual must have 35 years old or more;

the individual must belong to the French-Canadian population;

the individual must have one or two first degree relative available for blood sampling.

Controls were matched with cases sex when possible.

C) Cases and Control Populations Selected for the Association Study

The unaffected population retained for the study was composed of 241 individuals. The initial sample of the clinical study was composed of 215 cases and 214 controls. The controls were composed of 116 males and 98 females while the cases were composed of 154 males and 64 females. For each control, two first degree relatives (father, mother, sisters and brothers) were available. In order to match the sex of cases and controls, the parents of female controls were substituted for the female controls where possible and where the parents were known to be unaffected by schizophrenia or other psychosis. The parents of 27 female controls were thus substituted for the respective females, resulting in a total control sample size of 241 individuals. The composition of the control sample is detailed below in Table 7.

TABLE 7

Description of control samples

| | |
|---|---|
| Probands | 187 |
| Male | 116 |
| Female | 71 |
| Parents of probands | 54 |
| Fathers | 27 |
| Mothers | 27 |
| Total | 241 |

The association data that are presented below were obtained on a population size detailed in Table 8 below, wherein the individuals have been randomly selected from the populations detailed above.

TABLE 8

Cases and Control Populations Selected for the Association Study

| | | Cases | Controls |
|---|---|---|---|
| sample type | | | |
| sample size | | 215 | 241 |
| Gender | | | |
| | Male | 151 | 143 |
| | Female | 64 | 98 |
| Familial history of psychosis (FH)* | | | |
| | positive (FH+) | 82 | 0 |
| | none (FH−) | 133 | 241 |

*close relatives (first or second degree)

Both case and control populations form two groups, each group consisting of unrelated individuals that do not share a known common ancestor. Additionally, the individuals of the control population were selected among those having no family history of schizophrenia or schizophrenic disorder.

Genotyping of Affected and Control Individuals

A) Results from the Genotyping

The general strategy to perform the association studies was to individually scan the DNA samples from all individuals in each of the populations described above in order to establish the allele frequencies of biallelic markers, and among them the biallelic markers of the invention, in the diploid genome of the tested individuals belonging to each of these populations.

Allelic frequencies of every biallelic marker in each population (cases and controls) were determined by performing microsequencing reactions on amplified fragments obtained by genomic PCR performed on the DNA samples from each individual. Genomic PCR and microsequencing were performed as detailed above in Examples 1 to 4 using the described PCR and microsequencing primers.

Single Biallelic Marker Frequency Analysis

For each allele of the biallelic markers included in this study, the difference between the allelic frequency in the unaffected population and in the population affected by schizophrenia was calculated and the absolute value of the difference was determined. The more the difference in allelic frequency for a particular biallelic marker or a particular set of biallelic markers, the more probable an association between the genomic region harboring this particular biallelic marker or set of biallelic markers and schizophrenia. Allelic frequencies were also useful to check that the markers used in the haplotype studies meet the Hardy-Weinberg proportions (random mating).

The allelic frequencies of biallelic markers in the chromosome 13q31–q33 region between the affected and the unaffected population, using the sample population described above, is set forth in Table 9.

TABLE 9

Allelic frequencies of markers in different sub-samples

| marker | alleles | all sample | | | |
|---|---|---|---|---|---|
| | | cases | | | |
| | | all | HF+ | HF− | controls |
| 99-20978/89 | C/G | 0.51 | 0.47 | 0.51 | 0.55 |
| 99-20983/48 | A/G | 0.30 | 0.28 | 0.33 | 0.29 |
| 99-20981/300 | A/G | 0.54 | 0.51 | 0.55 | 0.56 |
| 99-20977/72 | A/C | 0.40 | 0.41 | 0.38 | 0.35 |
| 99-6080/99 | C/T | 0.58 | 0.57 | 0.57 | 0.55 |
| 99-15229/412 | A/G | 0.54 | 0.52 | 0.55 | 0.53 |
| 99-22310/48 | C/T | 0.46 | 0.48 | 0.44 | 0.47 |
| 99-15232/291 | C/T | 0.46 | 0.48 | 0.43 | 0.47 |
| 99-14021/108 | A/G | 0.46 | 0.48 | 0.44 | 0.47 |
| 8-98/68 | A/G | 0.20 | 0.18 | 0.23 | 0.19 |
| 8-97/98 | C/T | 0.78 | 0.75 | 0.81 | 0.80 |
| 99-6012/220 | C/T | 0.20 | 0.19 | 0.23 | 0.19 |
| 8-95/43 | A/G | 0.18 | 0.20 | 0.18 | 0.21 |
| 99-7308/157 | C/T | 0.39 | 0.42 | 0.36 | 0.39 |
| 99-14364/415 | C/T | 0.38 | 0.40 | 0.36 | 0.39 |
| 99-15672/166 | C/T | 0.51 | 0.47 | 0.54 | 0.54 |
| 99-15668/139 | C/T | 0.58 | 0.56 | 0.62 | 0.65 |
| 99-15665/398 | A/G | 0.72 | 0.67 | 0.72 | 0.76 |
| 99-15663/298 | C/T | 0.72 | 0.67 | 0.72 | 0.76 |
| 99-15664/185 | C/T | 0.69 | 0.62 | 0.72 | 0.72 |
| 99-15682/318 | A/T | 0.35 | 0.40 | 0.34 | 0.32 |
| 99-20933/81 | A/C | 0.43 | 0.41 | 0.42 | 0.40 |
| 99-16081/217 | C/T | 0.43 | 0.38 | 0.46 | 0.39 |
| 99-16082/218 | A/G | 0.33 | 0.31 | 0.35 | 0.32 |
| 99-5862/167 | C/T | 0.47 | 0.43 | 0.44 | 0.51 |
| 99-16100/147 | A/G | 0.48 | 0.44 | 0.45 | 0.50 |
| 99-7652/162 | A/G | 0.49 | 0.46 | 0.46 | 0.52 |
| 99-5919/215 | A/G | 0.66 | 0.71 | 0.69 | 0.60 |
| 99-5897/143 | A/C | 0.58 | 0.61 | 0.53 | 0.59 |
| 99-15870/400 | A/G | 0.32 | 0.38 | 0.27 | 0.33 |
| 99-16032/292 | A/C | 0.61 | 0.62 | 0.64 | 0.58 |
| 99-15880/162 | A/G | 0.62 | 0.63 | 0.65 | 0.58 |
| 99-16038/118 | A/G | 0.38 | 0.36 | 0.35 | 0.42 |
| 99-15875/165 | C/T | 0.58 | 0.57 | 0.57 | 0.63 |
| 99-16033/244 | C/T | 0.55 | 0.57 | 0.49 | 0.54 |
| 99-16047/115 | C/T | 0.73 | 0.75 | 0.68 | 0.73 |

Figure 2:
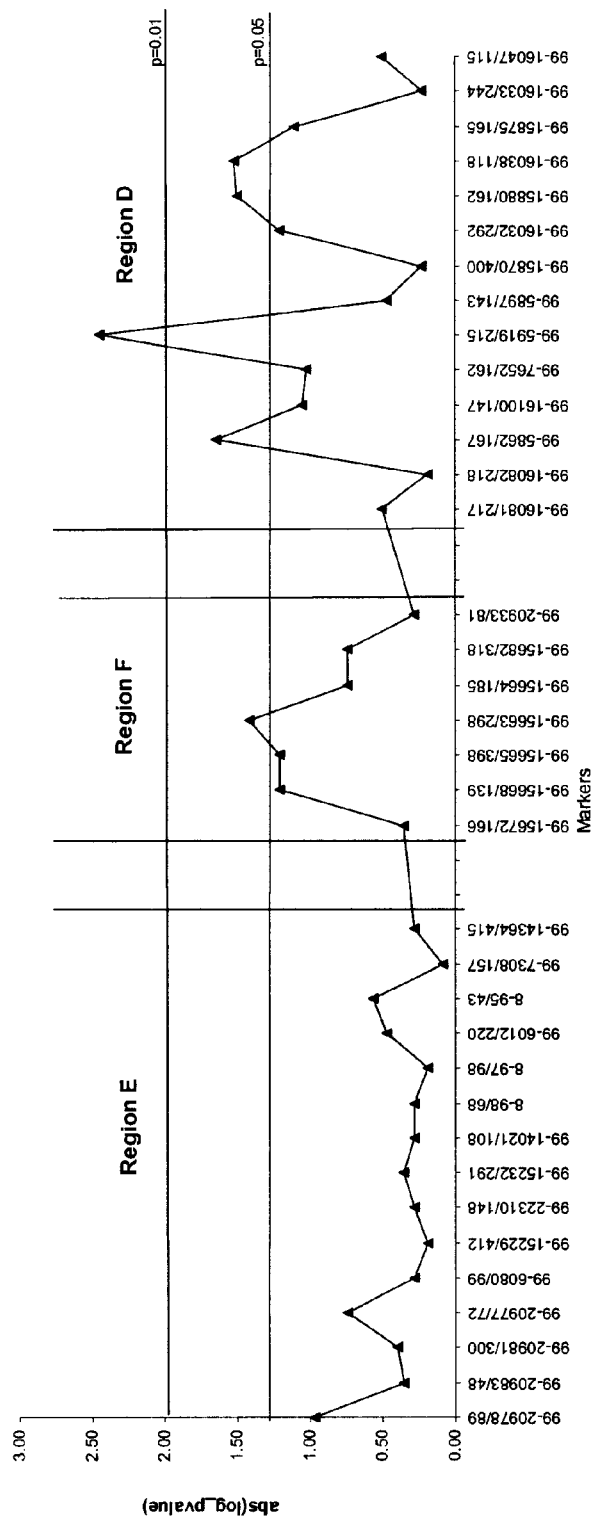
FIG. 2 is a table demonstrating the statistical significance of allelic frequencies of selected chromosome 13q31–q33 biallelic markers of the invention in sporadic and familial French Canadian schizophrenia cases and controls.

In the association study described herein, several individual biallelic markers were shown to be significantly associated with schizophrenia. In particular, several of the chromosome 13q31–q33 region biallelic markers (99-16038/118 (A56), 99-7652/162 (A8), 99-5919/215 (A11), 99-15875/165 (A68), 99-16032/292 (A9)) showed significant association with schizophrenia in both familial and sporadic schizophrenia cases. The significance of the absolute value of the difference of allelic frequency of the individual biallelic markers in the affected and the unaffected population is set forth in 2, with several biallelic marker having allelic frequency differences with p-values approaching or less than 0.05, biallelic marker 99-5919/215 (A11) having a p-value of less than 0.01. FIG. 2 also shows the physical order of certain specific biallelic markers. These results show that several biallelic markers individually associated with schizophrenia are physically located in a particular region of significance, the subregion of the chromosome 13q31 –q33 region referred to herein as Region D.

Haplotype Frequency Analysis

Analysis of markers Haplotype analysis for association of chromosome 13q31–q33-related biallelic markers and schizophrenia was performed by estimating the frequencies of all possible 2, 3 and 4 marker haplotypes in the affected and control populations described above. Haplotype estimations were performed by applying the Expectation-Maximization (EM) algorithm (Excoffier and Slatkin, 1995), using the EM-HAPLO program (Hawley et al., 1994) as described above. Estimated haplotype frequencies in the affected and control population were compared by means of a chi-square statistical test (one degree of freedom).

Haplotype Association Results in Schizophrenia Cases

The results of the haplotype analysis using the chromosome 13q31–q33-related biallelic markers biallelic markers is shown in FIG. 3. In particular, the figures show the most significant haplotypes using the biallelic markers: 99-16047/115 (A10), 99-16033/244 (A67), 99-16038/118 (A56), 99-15875/165 (A68), 99-16032/292 (A9), 99-5897/143 (A47), 99-15880/162 (A58), 99-16082/218 (A97), 99-5919/215 (A11), 99-7652/162 (A8), 99-16100/147 (A9), 99-5862/167 (A10).

A number of biallelic marker haplotypes were shown to be significantly associated with schizophrenia. A first preferred haplotype (HAP287 of FIG. 3) consisting of four biallelic markers (99-16038/118 (A56), 99-16082/218 (A97), (99-7652/162 (A8) and 99-16100/141 (A9)) is highly significantly associated with schizophrenia in both total cases and sporadic cases. FIG. 4 shows the characteristics of this haplotype. This haplotype presented a p-value of $3.1 \times 10^{-7}$ and an odd-ratio of 4.01 for total cases and a p-value of $3.9 \times 10^{-6}$ and an odd-ratio of 3.88 for sporadic cases. Phenotypic permutation tests confirmed the statistical significance of these results. Estimated haplotype frequencies were 13.8% in total cases, 13.5% in the sporadic cases, and 3.8% in the controls.

Several other significant haplotypes are listed in FIG. 3, including several 2-, 3- and 4-marker haplotypes. Considered to be highly significantly associated with schizophrenia are the most significant 2-marker haplotype (HAP1 consisting of biallelic markers 99-15875/165 (A68) and 99-5919/215 (A11)) and the most significant 3-marker haplotype (HAP67 consisting of biallelic markers 99-16038/118 (A56), 99-16082/218 (A97) and 99-7652/162 (A8)).

Further preferrred significant haplotypes considered associated with schizophrenia are haplotypes having p-values above a desired threshold level are also; all the haplotypes listed in FIG. 3 present p-values below $1.0 \times 10^{-2}$ for 2-marker haplotypes, $1.0 \times 10^{-4}$ for 3-marker haplotypes, and $1.0 \times 10^{-5}$ for 4-marker haplotypes. All of the biallelic markers presented in FIG. 4 except for 1 (99-16047/115 (A70)) are involved in haplotypes having a p-value above these threshold levels. FIG. 3 shows several 2-marker haplotypes, HAP1 to HAP8, having p-values ranging from $1.0 \times 10^{-2}$ to $1.2 \times 10^{-3}$, several 3-marker haplotypes, HAP67 to HAP76, having p-values ranging from $1.3 \times 10^{-5}$ to $1.0 \times 10^{-4}$ and several 4-marker haplotypes, HAP287 to HAP291, having p-values ranging from $8.2 \times 10^{-7}$ to $3.1 \times 10^{-7}$. FIG. 4 shows biallelic markers involved in significant haplotypes having significance thresholds of $1.0 \times 10^{-2}$, $1.0 \times 10^{-4}$, and $1.0 \times 10^{-5}$ for 2-, 3- and 4-marker haplotypes, respectively.

Several 2-, 3- and 4-marker haplotypes, HAP 1, HAP8, HAP70, HAP71, HAP75, HAP76, HAP288, HAP290 and HAP291, often comprised the biallelic marker 99-5919/215 (A11) allele A. Furthermore, several 2-, 3- and 4-marker haplotypes, HAP7, HAP67, HAP69, HAP75, HAP287 AND HAP288, often comprised the biallelic marker 99-16038/118 (A56) allele G.

Example 5b

Association Study Between Schizophrenia and the Biallelic Markers of the Invention

Collection of DNA Samples from Affected and Non-Affected Individuals

Biallelic markers of the invention were further analyzed in the French Canadian population described above. For this analysis, the proband case population under study consisted of 139 individuals, the control population consisted of 141 individuals, as described in Table 10 below.

TABLE 10

Cases and Control Populations Selected for the Association Study

| Sample type | Cases | Controls |
|---|---|---|
| Sample size | 139 | 141 |
| Gender | | |
| Male | 94 | 96 |
| Female | 45 | 45 |
| Familial history of psychosis (FH)* | | |
| positive (FH+) | 76 | 0 |
| none (FH−) | 63 | 141 |

*close relatives (first or second degree)

Genotyping of Affected and Control Individuals

A) Results from the Genotyping

The general strategy for performing the association studies was to individually scan the DNA samples from all individuals in each of the populations described above in order to establish the allele frequencies of biallelic markers, and among them the biallelic markers of the invention, in the diploid genome of the tested individuals belonging to each of these populations.

Allelic frequencies of every biallelic marker in each population (cases and controls) were determined by performing microsequencing reactions on amplified fragments obtained by genomic PCR performed on the DNA samples from each individual. Genomic PCR and microsequencing were performed as detailed above in Examples 1 to 3 using the described PCR and microsequencing primers.

Single Biallelic Marker Frequency Analysis

For each allele of the biallelic markers included in this study, the difference between the allelic frequency in the unaffected population and in the population affected by schizophrenia was calculated and the absolute value of the difference was determined. The allelic frequencies of between the affected and the unaffected population in the regions is set forth in Table 11, using the sample population described above and in Table 10. The more the difference in allelic frequency for a particular biallelic marker or a particular set of biallelic markers, the more probable an association between the genomic region harboring this particular biallelic marker or set of biallelic markers and schizophrenia. Allelic frequencies were also useful to check that the markers used in the haplotype studies meet the Hardy-Weinberg proportions (random mating).

TABLE 11

Allelic frequencies of markers in differents sub-samples (%)

| | | | Cases | | All |
|---|---|---|---|---|---|
| Marker | polymorphism | All cases | HF+ | HF− | controls |
| 99-20978/89 | C/G | 50, 37 | 47, 26 | 54, 03 | 55, 43 |
| 99-20983/48 | A/G | 30, 37 | 28, 67 | 32, 5 | 26, 52 |
| 99-20977/72 | A/C | 41, 01 | 42, 11 | 39, 68 | 34, 4 |

TABLE 11-continued

Allelic frequencies of markers in differents sub-samples (%)

| | | | Cases | | All |
|---|---|---|---|---|---|
| Marker | polymorphism | All cases | HF+ | HF− | controls |
| 99-20981/300 | A/G | 52, 17 | 51, 33 | 53, 17 | 60 |
| 99-6080/99 | C/T | 58, 82 | 58 | 59, 84 | 54, 85 |
| 99-15229/412 | A/G | 54, 92 | 52, 86 | 57, 26 | 51, 88 |
| 99-22310/148 | C/T | 44, 2 | 46, 71 | 41, 13 | 48, 57 |
| 99-15232/291 | G/T | 43, 85 | 46, 43 | 40, 83 | 49, 28 |
| 99-14021/108 | A/G | 44, 85 | 47, 26 | 42, 06 | 48, 54 |
| 8-94/252 | A/G | 2, 22 | 1, 97 | 2, 54 | 2, 52 |
| 8-98/68 | A/G | 19, 06 | 17, 76 | 20, 63 | 19, 06 |
| 8-97/98 | C/T | 76, 26 | 74, 34 | 78, 57 | 77, 3 |
| 99-6012/220 | G/T | 20 | 18, 49 | 21, 77 | 18, 79 |
| 99-7308/157 | C/T | 40, 31 | 41, 89 | 38, 18 | 39, 36 |
| 99-14364/415 | C/T | 39, 93 | 40, 79 | 38, 89 | 40 |
| 8-95/43 | A/G | 20, 29 | 20, 39 | 20, 16 | 22, 14 |
| 99-15672/166 | C/T | 49, 28 | 47, 37 | 51, 59 | 56, 74 |
| 99-15668/139 | C/T | 58, 21 | 56, 16 | 60, 66 | 66, 67 |
| 99-15665/398 | A/G | 70, 5 | 67, 76 | 73, 81 | 76, 79 |
| 99-15663/298 | C/T | 70, 5 | 67, 76 | 73, 81 | 76, 95 |
| 99-15664/185 | G/T | 66, 54 | 62, 33 | 71, 43 | 72, 5 |
| 99-15682/318 | A/T | 35, 27 | 39, 58 | 29, 82 | 32, 66 |
| 99-20933/81 | A/C | 43, 12 | 42, 76 | 43, 55 | 42, 45 |
| 99-26146/264 | G/T | 39, 62 | 38, 67 | 40, 91 | 38, 85 |
| 99-25922/147 | G/T | 44, 19 | 39, 58 | 50 | 40, 94 |
| 99-16081/217 | C/T | 42, 28 | 38, 82 | 46, 67 | 36, 74 |
| 99-16082/218 | A/G | 34, 73 | 31, 94 | 38, 14 | 33, 81 |
| 99-24656/260 | A/G | 48, 87 | 49, 32 | 48, 31 | 54, 04 |
| 99-24639/163 | G/T | 38, 52 | 33, 33 | 45 | 40, 51 |
| 99-24634/108 | A/T | 44, 85 | 42, 67 | 47, 54 | 50 |
| 99-7652/162 | A/G | 45, 29 | 44, 08 | 46, 77 | 50, 36 |
| 99-16100/147 | A/G | 44, 66 | 42, 75 | 46, 77 | 48, 89 |
| 99-5862/167 | C/T | 43, 53 | 41, 45 | 46, 03 | 49, 29 |
| 99-5919/215 | A/G | 69, 42 | 71, 05 | 67, 46 | 60, 28 |
| 99-24658/410 | C/T | 64, 13 | 69, 08 | 58, 06 | 61, 07 |
| 99-24644/194 | A/G | 39, 42 | 41, 22 | 37, 3 | 40, 51 |
| 99-5897/143 | A/C | 57, 61 | 60, 67 | 53, 97 | 61, 07 |
| 99-24649/186 | C/T | 67, 75 | 67, 33 | 68, 25 | 62, 95 |
| 99-15870/400 | A/G | 33, 46 | 36, 67 | 29, 51 | 30, 29 |
| 99-16038/118 | A/G | 34, 53 | 36, 18 | 32, 54 | 43, 62 |
| 99-15880/162 | A/G | 65, 11 | 63, 16 | 67, 46 | 56, 43 |
| 99-25940/182 | A/G | 59, 42 | 56, 67 | 62, 7 | 52, 59 |
| 99-16032/292 | A/C | 64, 03 | 61, 84 | 66, 67 | 55, 67 |
| 99-16033/244 | C/T | 54, 51 | 56, 76 | 51, 69 | 56, 44 |
| 99-15875/165 | C/T | 56, 88 | 57, 89 | 55, 65 | 66, 3 |
| 99-16047/115 | C/T | 71, 69 | 74, 67 | 68, 03 | 75, 19 |
| 99-25993/367 | A/G | 44, 53 | 40, 79 | 49, 18 | 40, 51 |
| 99-25989/398 | A/G | 32, 81 | 33, 33 | 32, 2 | 27, 86 |
| 99-25979/93 | A/G | 68, 12 | 69, 08 | 66, 94 | 69, 32 |
| 99-25969/200 | G/T | 36, 67 | 38, 67 | 34, 17 | 38, 85 |
| 99-25966/241 | A/G | 66, 3 | 67, 11 | 65, 32 | 63, 21 |
| 99-25961/376 | A/C | 39, 63 | 42, 57 | 36, 07 | 37, 31 |
| 99-25965/399 | A/G | 50, 36 | 51, 97 | 48, 39 | 49, 64 |
| 99-25977/311 | A/G | 72, 01 | 67, 76 | 77, 59 | 73, 72 |
| 99-25950/121 | C/G | 31, 75 | 36 | 26, 61 | 27, 54 |
| 99-25974/143 | A/G | 25, 55 | 28, 29 | 22, 13 | 22, 7 |
| 99-26150/276 | A/G | 46, 54 | 51, 43 | 40, 83 | 47, 76 |
| 99-15258/337 | G/T | 25, 55 | 26, 97 | 23, 77 | 24, 1 |
| 99-15261/202 | A/G | 63, 06 | 59, 46 | 67, 5 | 65, 15 |
| 99-15256/392 | C/T | 64, 96 | 61, 33 | 69, 35 | 65, 3 |
| 99-15056/99 | C/T | 32, 72 | 36, 49 | 28, 23 | 31, 11 |
| 99-15280/432 | C/T | 42, 28 | 44 | 40, 16 | 38, 97 |
| 99-15355/150 | C/T | 72, 3 | 70, 39 | 74, 6 | 68, 79 |
| 99-15253/382 | C/T | 63, 04 | 62, 67 | 63, 49 | 62, 95 |
| 99-5873/159 | C/T | 78, 1 | 79, 05 | 76, 98 | 77, 34 |

Haplotype Frequency Analysis

Analysis of markers Haplotype analysis for association of chromosome 13q31 −q33-related biallelic markers and schizophrenia was performed by estimating the frequencies of all possible 2, 3 and 4 marker haplotypes in the affected and control populations described above. Haplotype estimations were performed by applying the Expectation-Maximization (EM) algorithm (Excoffier and Slatkin, 1995), using the EM-HAPLO program (Hawley et al., 1994) as described above. Estimated haplotype frequencies in the affected and control population were compared by means of a chi-square statistical test (one degree of freedom).

Haplotype Association Results in Schizophrenia Cases

Figure 6:
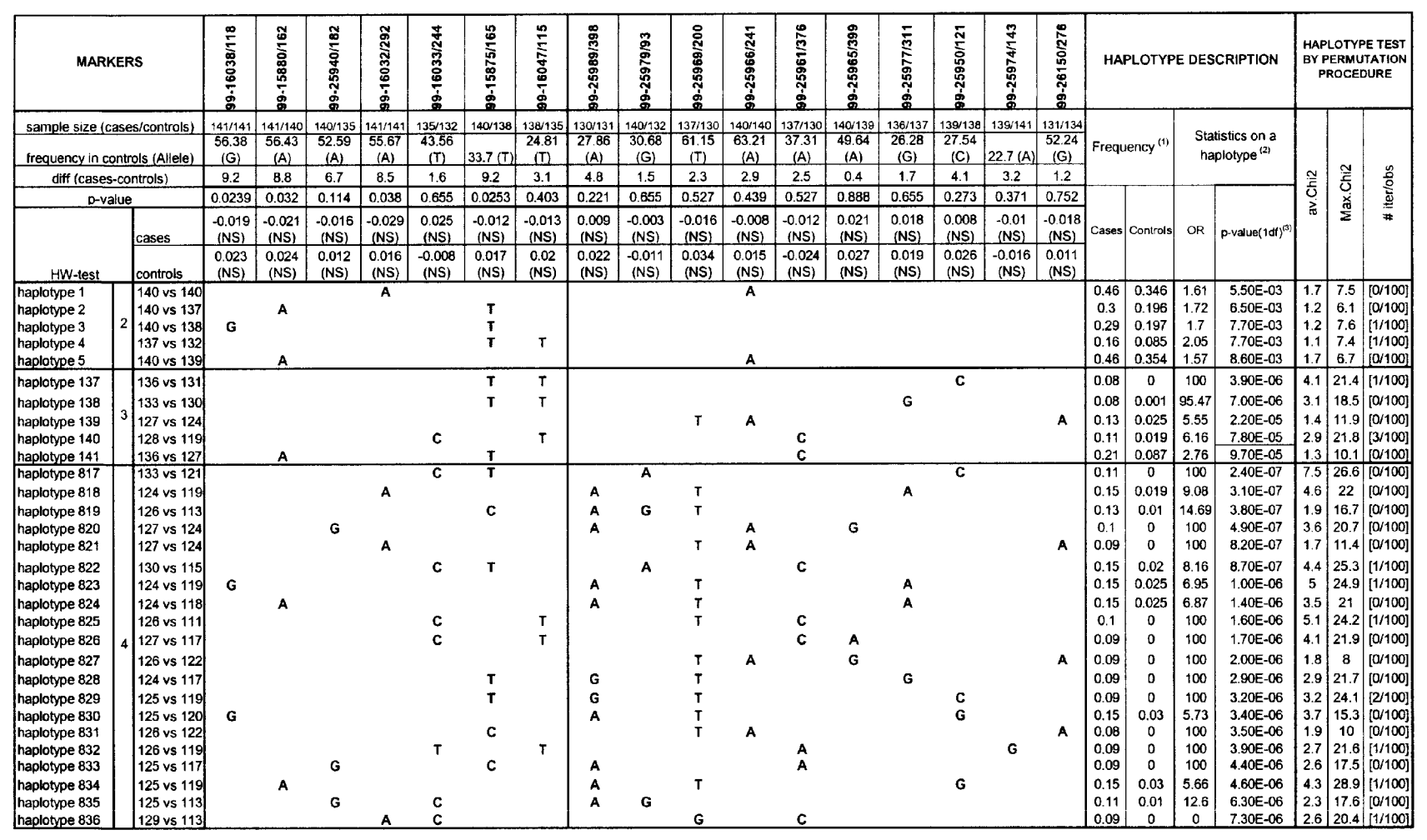

Haplotype studies yielded significant results indicating an association of the nucleotide sequences of the invention with schizophrenia. Significant results are shown in FIGS. 5 and 6, including descriptions of the frequency of the haplotype leading to the maximum chi square test (reference no. (1) in figures),. the test of the frequency of a particular haplotype in cases vs in controls (reference no. (2) in figures) and the p-value assuming that the test has a chi-square distribution with 1 degree of freedom (dd1) (reference no. (3) in figures). The results of the haplotype analysis using 28 preferred biallelic markers of the invention, 99-24656-260 (A5), 99-24639-163 (A6), 99-24634-108 (A7), 99-7652-162 (A8), 99-16100-147 (A9), 99-5862-167 (A10), 99-5919-215 (A11), 99-24658-410 (A12), 99-24644-194 (A19), 99-5897-143 (A47), 99-24649-186 (A48), 99-16038-118 (A56), 99-15880-162 (A58), 99-25940-182 (A64), 99-16032-292 (A9), 99-16033-244 (A67), 99-15875-165 (A68), 99-16047-115 (A70), 99-25950-121 (A105), 99-25961-376 (A106), 99-25965-399 (A103), 99-25966-241 (A108), 99-25969-200 (A110), 99-25974-143 (A112), 99-25977-311 (A113), 99-25979-93 (A114), 99-25989-398 (A116), and 99-26150-276 (A118) are shown in FIGS. 5 and 6. FIGS. 5 and 6 also show the physical order of the biallelic markers comprising the haplotypes.

FIG. 5 shows the results of the haplotype analysis using the following biallelic markers located on the approximately 319 kb sequence of SEQ ID No. 1: 99-24656-260 (A5), 99-24639-163 (A6), 99-24634-108 (A7), 99-7652-162 (A8), 99-16100-147 (A9), 99-5862-167(A10), -99-5919-215 (A11), 99-24658-410 (A12), 99-24644-194 (A19), 99-5897-143 (A47), 99-24649-186 (A48), 99-16038-118 (A56), 99-15880-162 (A58), 99-25940-182 (A64), 99-16032-292 (A65), 99-16033-244 (A67), 99-15875-165 (A68), and 99-16047-115 (A70).

FIG. 6 shows the results of the haplotype analysis using the following biallelic markers located on the approximately 319 kb of SEQ ID No. 1 as well as additional biallelic markers located on the human chromosome 13q31–q33 locus: 199-16038-118 (A56), 99-15880-162 (A58), 99-25940-182 (A64), 99-16032-292 (A65), 99-16033-244 (A67) 99-15875-165 (A68), 99-16047-115 (A70), 99-25950-121 (A105), 99-25961-376 (A106), 99-25965-399 (A102), 99-25966-241 (A108), 99-25969-200 (A110), 99-25974-143 (A112), 99-25977-311 (A113), 99-25979-93 (A114), 99-25989-398 (A116), and 99-26150-276 (A119).

A number of biallelic marker haplotypes were shown to be significantly associated with schizophrenia.

Several preferred haplotype all showing highly significant association with schizophrenia and including various 2-, 3- and 4-marker haplotypes are haplotypes 817, 818 and 819, 137, 138, 1 and 2 of FIG. 6, and haplotypes 970, 154 and 1 of FIG. 5. The p-values, odd-ratios and estimated haplotype frequencies are further described in FIGS. 5 and 6. In particular, the two marker haplotype 1 of FIG. 5 consisting of biallelic markers 99-5862-167 (A10) and 99-15875-165 (A68) showed a highly significant p-value of $7.8 \times 10^{-5}$ and an odd-ratio of 1.61. Haplotype 818 of FIG. 6 consisting of four biallelic markers (99-16032-292 (A65), 99-25969-200 (A110), 99-25977-311 (A113), and 99-25989-398 (A116)) presented a p-value of $3.1 \times 10^{-7}$ and an odd-ratio of 9.08. Another example showing significance is haplotype 817 of FIG. 6 consisting of four biallelic markers (99-16033-244 (A67), 99-15875-165 (A68), 99-25950-121 (A105) and 99-25979-93 (A114)), presented a p-value of $2.4 \times 10^{-7}$ and an odd-ratio of 100. Phenotypic permutation tests confirmed the statistical significance of these results. Estimated haplotype frequencies were 10.5% in cases and 0% in the controls. Haplotype 970 of FIG. 5 consisting of four biallelic markers (99-5919-215 (A11), 99-24658-410 (A12), 99-15875-165 (A68), and 99-16047-115 (A10)) presented a p-value of $7.8 \times 10^{-7}$ and an odd-ratio of 2.41. Phenotypic permutation tests confirmed the statistical significance of these results. Estimated haplotype frequencies were 25.7% in cases and 12.5% in the controls.

Several other significant haplotypes are listed in FIGS. 5 and 6, including several 2-, 3- and 4-marker haplotypes. Considered to be highly significantly associated with schizophrenia are the most significant 2-marker haplotypes (for example haplotype 1 of FIG. 5 noted above and the most significant 3-marker haplotypes (for example haplotype 137 of FIG. 6 consisting of biallelic markers (99-15875-165 (A68), 99-16047-115 (A70) and 99-25950-121 (A105)).

Further preferrred significant haplotypes considered associated with schizophrenia are haplotypes having p-values above a desired threshold level; all the haplotypes listed in FIGS. 5 and 6 present p-values below $1.0 \times 10^{-2}$ for 2-marker haplotypes, $1.0 \times 10^{-4}$ for 3-marker haplotypes, and $1.0 \times 10^{-5}$ for 4-marker haplotypes. FIGS. 5 and 6 show several 2-marker haplotypes, haplotypes 1 to 9 and haplotypes 1 to 5 of FIGS. 5 and 6 respectively, having p-values ranging from $7.8 \times 10^{-5}$ to $8.6 \times 10^{-3}$, several 3-marker haplotypes, haplotypes 154 to 163 and 137 to 141 of FIGS. 5 and 6 respectively, having p-values ranging from $3.9 \times 10^{-6}$ to $1.1 \times 10^{-4}$ and several 4-marker haplotypes, haplotypes 970 to 973 and 817 to 836 of FIGS. 5 and 6 respectively, having p-values ranging from $2.4 \times 10^{-7}$ to $7.3 \times 10^{-6}$.

Additionally, a particularly large number of the significant 2-, 3- and 4-marker haplotypes often comprised the biallelic markers A65, A12, A67, A70, A107, A110, A116 and most commonly A108 (99-15875-165), allele T.

The statistical significance of the results obtained for the haplotype analysis was evaluated by a phenotypic permutation test reiterated 100 times on a computer. For this computer simulation, data from the affected and control individuals were pooled and randomly allocated to two groups which contained the same number of individuals as the case-control populations used to produce the data summarized in FIGS. 5 and 6. A haplotype analysis was then run on these artificial groups for the markers included in the haplotypes showing strong association with schizophrenia. This experiment was reiterated 100 times and the results are shown in the columns of FIGS. 5 and 6 labelled "Haplotype test by permutation procedure". For a given haplotype, these results demonstrate the number of obtained (simulated) haplotypes having a p-value comparable to the one obtained for the given haplotype among 100 iterations. These results, set forth in FIGS. 5 and 6 validate the statistical significance of the association between the haplotypes and schizophrenia.

Example 5c

Association Study between Schizophrenia and the Biallelic Markers of the Invention in French Canadian Samples Collection of DNA Samples from Affected and Non-affected Individuals Biallelic markers of the present invention were further genotyped in French Canadian samples as described above in order to compare the association of the 1st and the 2nd portion of Region D with schizophrenia. The population used in the study was the same as described above with the exception that 2 male FH+ cases were not included.

The biallelic markers analyzed in the study include 34 preferred biallelic markers of the invention located in Region D of the chromosome 13q31–33 region. Included in the analysis were the 14 following biallelic markers from the first of two portions of Region D: 99-26150/276 (A118), 99-26156/290 (A120), 99-26153/44 (A119), 99-25985/194 (A115), 99-25974/143 (A112), 99-25977/311 (A114), 99-25972/317 (A111), 99-25965/399 (A107), 99-25961/376 (A106), 99-25966/241 (A108), 25967/57 (A109), 99-25969/200 (A110), 99-25979/93 (A114) and 99-25989/398 (A116). Included in the analysis were also the 20 following biallelic markers from the second of two portions of Region D: 99-25993/367 (A71), 99-16047/115 (A70), 99-15875/165 (A68), 99-16033/244 (A67), 99-16032/292 (A65), 99-25940/182 (A64), 99-15880/162 (A58), 99-16038/118 (A56), 99-15870/400 (A53), 99-24649/186 (A48), 99-5897/143 (A47), 99-24644/194 (A19), 99-24658/410 (A12), 99-5919/215 (A11), 99-5862/167 (A10),99-16100/147 (A9), 99-7652/162 (A8), 99-24634/108 (A7), 99-24639/163 (A6) and 99-24656/260 (A5).

Single Biallelic Marker Association Results in Schizophrenia Cases

Single biallelic marker studies yielded significant results, indicating an association of the nucleotide sequences of the invention with schizophrenia. Biallelic markers used in the analysis included the set of 34 biallelic markers shown in Table 11 below, 14 biallelic markers of which were located on the first of two portions of Region D, and 20 of which were located on the second portion. The distribution of markers in shown in Table 12 below. As summarized in Table 13, analyses using these biallelic markers demonstrated a significant association with schizophrenia for 5 markers on the second portion of Region D.

TABLE 11

| REGION | CONTIG | SNPS GENOTYPED | POLY-MORPHISM | FREQUENCY IN CONTROLS |
|---|---|---|---|---|
| D | 1st portion | 99-26150/276 | A/G | 50 |
| | | 99-26156/290 | A/C | 69 |
| | | 99-26153/44 | A/C | 61 |
| | | 99-25985/194 | C/T | 29 |
| | | 99-25974/143 | A/G | 25 |
| | | 99-25977/311 | A/G | 73 |
| | | 99-25972/317 | C/T | 72 |
| | | 99-25965/399 | A/G | 49 |
| | | 99-25961/376 | A/C | 40 |
| | | 99-25966/241 | A/G | 63 |
| | | 99-25967/57 | A/G | 43 |
| | | 99-25969/200 | G/T | 40 |
| | | 99-25979/93 | A/G | 72 |
| | | 99-25989/398 | A/G | 29 |
| | | 99-25993/367 | A/G | 44 |
| | | 99-16047/115 | C/T | 73 |
| | | 99-15875/165 | C/T | 63 |
| | 2nd portion | 99-16033/244 | C/T | 54 |
| | | 99-16032/292 | A/C | 58 |
| | | 99-25940/182 | A/G | 53 |
| | | 99-15880/162 | A/G | 58 |
| | | 99-16038/118 | A/G | 42 |
| | | 99-15870/400 | A/G | 33 |
| | | 99-24649/186 | C/T | 65 |
| | | 99-5897/143 | A/C | 59 |
| | | 99-24644/194 | A/G | 39 |
| | | 99-24658/410 | C/T | 58 |
| | | 99-5919/215 | A/G | 60 |
| | | 99-5862/167 | C/T | 51 |
| | | 99-16100/147 | A/G | 50 |
| | | 99-7652/162 | A/G | 52 |

TABLE 11-continued

| REGION | CONTIG | SNPS GENOTYPED | POLY-MORPHISM | FREQUENCY IN CONTROLS |
|---|---|---|---|---|
| | | 99-24634/108 | A/T | 53 |
| | | 99-24639/163 | G/T | 44 |
| | | 99-24656/260 | A/G | 54 |

TABLE 12

| Region | No. of Biallelic markers (σ) | Mean frequency (σ) | Mean inter-marker distance (σ) |
|---|---|---|---|
| D 1st half | 14 (14) | 0.34 (0.07) | 7 (6.3) |
| D 2nd half | 20 (8) | 0.42 (0.06) | 11 (13) |
| D 1st and 2nd half | 34 (22) | 0.39 (0.07) | 10.3 (11) |

Haplotype Frequency Analysis

Analysis of markers Haplotype analysis for association of chromosome 13q31–q33-related biallelic markers and schizophrenia was performed by estimating the frequencies of all possible 2, 3 and 4 marker haplotypes in the affected and control populations described above. Haplotype estimations were performed by applying the Expectation-Maximization (EM) algorithm (Excoffier and Slatkin, 1995), using the EM-HAPLO program (Hawley et al., 1994) as described above.

Haplotype Association Results in Schizophrenia Cases

Significant results were also obtained in haplotype studies indicating an association of the nucleotide sequences of the invention with schizophrenia.

The present inventors having previously demonstrated highly significant association of biallelic markers located on the Region D subregion of the human chromosome 13q31–q33 locus with disease. Using the Omnibus LR test which compares the profile of haplotype frequencies, and Haplo-maxM test which is based on haplotype differences for each haplotype in two groups, FIGS. 7 and 8 describe the results of an analysis of the first and second portions of Region D which demonstrated an association of the second portion of Region D with schizophrenia.

For combinations of 2 and 3 biallelic markers, one likelihood ratio test is obtained based on the haplotype frequency values calculated using the E-M algorithm. A permutation procedure was used, where data from the affected and control individuals was pooled and randomly allocated to two groups which contained the same number of individuals as the case-control populations used to produce the data. A haplotype analysis was then run on these artificial groups for the markers included in the haplotypes showing strong association with schizophrenia. This experiment was reiterated 100 times. For a given haplotype, these results demonstrate the number of obtained (simulated) haplotypes having a p-value comparable to the one obtained for the given haplotype among 100 iterations.

Figure 7A:
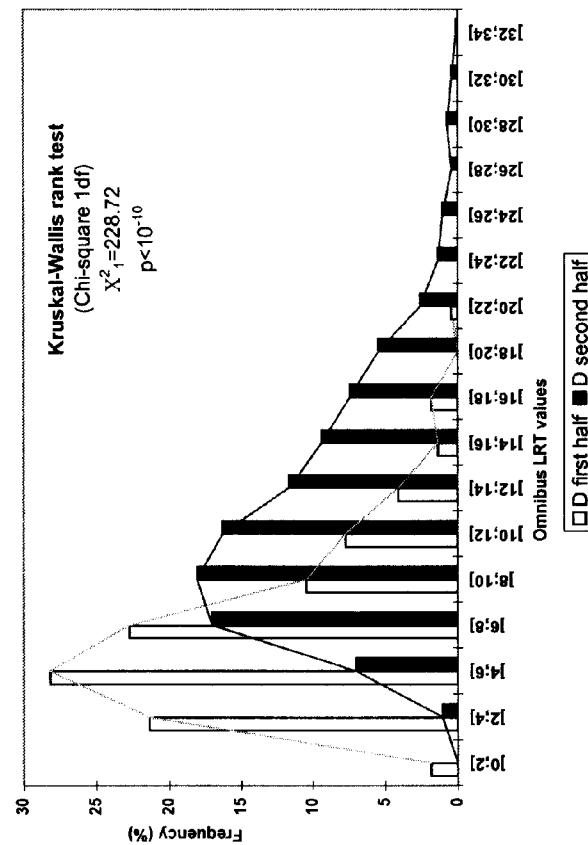
FIGS. 7A and 7B show the results of a haplotype association analysis (Omnibus LR test value distribution)
Figure 7B:
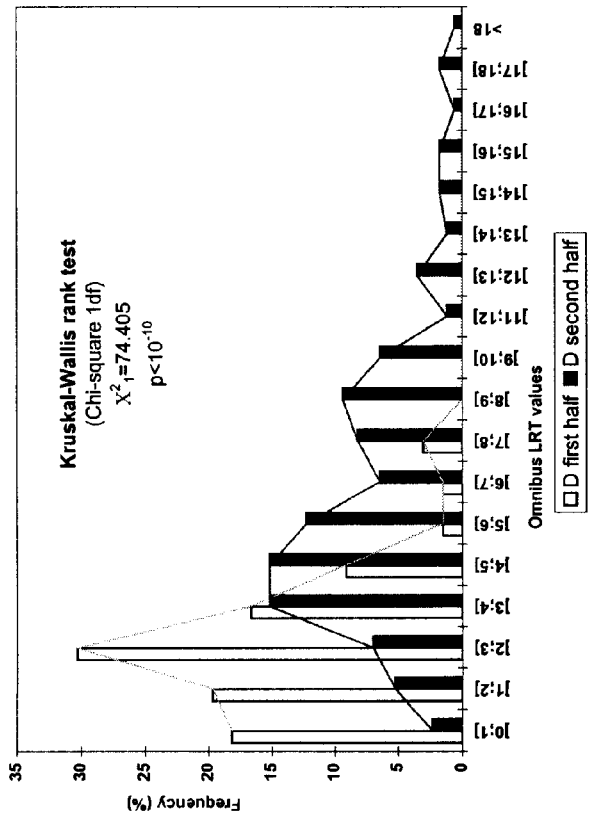

FIG. 7 shows a comparison of the LR test value distributions of haplotype frequencies in the two portions of Region D. This association of the second portion of Region D with schizophrenia is shown using both 2-marker and 3-marker combinations. The distribution of LR test values in the different regions was analyzed using a Kruskal-Wallis rank test, a chi-square test with r–1 degrees of freedom, where r represents the number of value sets compared. As shown, the significance of the association is demonstrated by a chi-square value (one degree of freedom) of 74.405 and a p-value of less than $1 \times 10^{-10}$ for 2 marker combinations, and a chi-square value (one degree of freedom) of 228.72 and a p-value of $1 \times 10^{-10}$ for 3-marker combinations.

Another association analysis approach based on haplotype frequency differences, referred to as the Haplo-maxM test, was conducted using region D biallelic markers. For one combination of markers having h haplotypes, h differences of haplotype frequencies can be compared via a Pearson chi-square statistic (one degree of freedom). The haplo-max test selects the difference showing the maximum positive test value between cases versus controls (rejecting test values based on rare haplotype frequencies, i.e, with an estimated number of haplotypes inferior to 10); for one combination of markers there is therefore one Max-M test value. The results of the Haplo-maxM test using Region D biallelic markers are shown in FIG. 8.

FIG. 8 shows the distribution of haplo-maxM test values obtained for both 2-marker and 3-marker combinations in the two portions of Region D, demonstrating an association of the second portion of Region D with schizophrenia. The comparison of the distribution of Haplo-maxM test values oin the two regions was analyzed using a Kruskal-Wallis rank test, a chi-square test with r−1 degrees of freedom, where r represents the number of value sets compared. As shown, the significance of the association is demonstrated by a chi-square value (one degree of freedom) of 34.839 and a p-value of less than $3.58 \times 10^{-9}$ for 2 marker combinations, and a chi-square value (one degree of freedom) of 13.773 and a p-value of $2.6 \times 10^{-4}$ for 3-marker combinations.

The results from the haplo-maxM tests further confirms the association shown using the Omnibus LR test results.

Results of association studies discussed above using biallelic markers of the invention are further summarized in Table 13 below, showing a significant association of the biallelic markers with schizophrenia in both single biallelic marker and haplotype analysis.

mated at about 400,000 inhabitants. Patients were evaluated by four doctors in 1994 and 1995. The study design involved in the ascertainment of cases and their first degree relatives (parents or siblings). 514 individuals were available for the study. This group consisted of 158 subjects from 51 different families, and 356 independent subjects.

As a whole, bipolar disorder cases were ascertained according to the diagnosis of bipolar disorder established by the DSM-IV (Diagnostic and Statistical Manual, Fourth edition, Revised 1994, American Psychiatric Press);

Available for consideration for each coded case were also age, sex, nationality of parents and grand parents, ethnic origin, familial composition, marital state, socio-economic level, educational level, professional situation, employment, receational activities, age of onset of phychiatric symptoms, age of first consultation, occurrences of obstetric or prenatal incidents, suicide attempts, other medical conditions, treatment for or occurrence of a neurological condition, familial occurrence of symptoms, previous or concurrent use of psychotropic drugs, other admissions to a hospital or medical treatments, and diagnostic reason for admission including (a) DSM-IV diagnosis and (b) symptoms first presented on admission to hospital.

Available for study were 226 bipolar disorder ascertained cases of which 203 were independent cases. This group consisted of 51 cases from 51 families, 20 cases in relatives thereof, and 155 independent cases. Upon elimination of 3 cases from the initial independent 155 cases due to discovery of a familial relation, the total number of independent cases was 203.

Cases were classified according to bipolar disorder type. The cases included 115 bipolar disorder type 1 individuals (including I rapid cycling case), 67 bipolar disorder type II individuals (including 1 rapid cycling case), 18 unclassified bipolar disorder cases, and 3 cases which remained unclassified due to lack of or inconsistent information.

TABLE 13

| | Single-point Analysis | | Multi-point analysis (Haplotype-based analysis) | | |
|---|---|---|---|---|---|
| | No. of allelic freq differences > 10% | No. Significant allelic tests | Omnibus LR TEST* | | |
| | | | 2-mks | 3-mks | 4-mks |
| Region D, 1st portion | 0 | 0 | 0, 03 | 0, 05 | 0, 06 |
| Region D, 2nd portion | 0 | 5 | 0, 30 | 0, 30 | 0, 31 |

*percentage of significant tests (5% level of significance)
Cases (N = 213)/Controls (N = 241)

Example 5d

Association Study between Bipolar Disorder and the Biallelic Markers of the Invention Description of Study Design Biallelic markers of the invention were analyzed in bipolar disorder cases. As in examples above, single and multi-point analyses showed a significant association of the markers of the invention, of Region D of the chromosome 13q33 locus, and more particularly of a sub-region of Region D with bipolar disorder.

A) Description of the Affected Population

All the samples were collected from a study of bipolar disorder undertaken in a hospital located south of Buenos Aires, Argentina, generally representing a population esti- The 203 independent cases were examined for a familial history of psychosis. 53 of these cases reported an occurrence of psychosis (characterized as schizophrenia or bipolar disorder) among first degree relatives (father, mother, brothers, sisters or children).

B) Decription of the Unaffected Population

Available for study were 201 controls which had not been affected by any psychiatric difficulties or reported any familial history of psychiatric difficulties. Available for consideration were also age, sex and ethnic origin of the unaffected population.

C) Case and Control Populations Selected for the Association Study

For the association study, the case population under study consisted of 201 individuals selected from the 226 total cases above; the control population consisted of 198 individuals selected from the 201 controls described above.

The association data that are presented in the Example 5d below were obtained on a population size detailed in Table 14 below.

TABLE 14

Cases and Control Populations
Selected for the Association Study

| Sample type | Cases | Controls |
|---|---|---|
| Sample size | 201 | 198 |
| Gender | | |
| Male | 68 | 81 |
| Female | 124 | 117 |
| Missing | 9 | |
| Ethnic origin | | |
| Causasian | 182 | 177 |
| Non caucasian | 5 | 21 |
| Missing | 14 | |
| Familial history of psychosis (FH)* | | |
| positive (FH+) | 54 | 0 |
| none (FH−) | 147 | 198 |

*close relatives (first degree)

Both case and control populations form two groups, each group consisting of unrelated individuals that do not share a known common ancestor.

Genotyping of Affected and Control Individuals

The general strategy was to individually scan the DNA samples from all individuals in each of the populations described above in order to establish the allele frequencies of biallelic markers, and among them the biallelic markers of the invention, in the diploid genome of the tested individuals belonging to each of these populations.

Allelic frequencies of every biallelic marker in each population (cases and controls) were determined by performing microsequencing reactions on amplified fragments obtained by genomic PCR performed on the DNA samples from each individual. Genomic PCR and microsequencing were performed as detailed above in Examples 1 to 4 using the described PCR and microsequencing primers.

Association Analysis

The association analysis included 30 preferred biallelic markers of the invention located in Region D of the chromosome 13q31–33 region. Included in the analysis were the 14 following biallelic markers from the first of two subjective portions of Region D: 99-26150/276 (A118), 99-26156/290 (A120), 99-26153/44 (A119), 99-25985/194 (A115), 99-25974/143 (A112), 99-25977/311 (A113), 99-25972/317 (A111), 99-25965/399 (A107), 99-25961/376 (A106), 99-25966/241 (A108), 25967/57 (A109), 99-25969/200 (A110), 99-25979/93 (A114) and 99-25989/398 (A116). Included in the analysis were also the 16 following biallelic markers from the second of two portions of Region D: 99-25993/367 (A71), 99-16047/115 (A70), 99-15875/165 (A68), 99-16033/244 (A67), 99-16032/292 (A66), 99-25940/182 (A65), 99-15880/162 (A58), 99-16038/118 (A56), 99-15870/400 (A53), 99-24649/186 (A48), 99-5897/143 (A47), 99-24644/194 (A19), 99-5919/215 (A11), 99-5862/167 (A10), 99-16100/147 (A9), and 99-7652/162 (A8).

A) Single Biallelic Marker Association Results in Bipolar Disorder Cases

For each allele of the biallelic markers included in this study, the difference between the allelic frequency in the unaffected population and in the population affected by bipolar disorder was calculated and the absolute value of the difference was determined. The set of biallelic markers and their allelic frequencies included in this study are set forth in Table 15. The more the difference in allelic frequency for a particular biallelic marker or a particular set of biallelic markers, the more probable an association between the genomic region harboring this particular biallelic marker or set of biallelic markers and bipolar disorder. Allelic frequencies were also useful to check that the markers used in the haplotype studies meet the Hardy-Weinberg proportions (under random mating assumptions)

TABLE 15

| REGION | CONTIG | POSITION ON CONTIG | SNPS GENOTYPED | POLYMORPHISM | FREQUENCY IN CONTROLS |
|---|---|---|---|---|---|
| D | Region D first Half | 168, 02 | 99-26150/276 | A/G | 62, 93 |
| | | 173, 29 | 99-26156/290 | A/C | 72, 42 |
| | | 177, 01 | 99-26153/44 | A/C | 52, 66 |
| | | 186, 41 | 99-25985/194 | C/T | 28, 87 |
| | | 190, 15 | 99-25974/143 | A/G | 31, 79 |
| | | 216, 43 | 99-25977/311 | A/G | 63, 82 |
| | | 224, 62 | 99-25972/317 | C/T | 72, 32 |
| | | 236, 64 | 99-25965/399 | A/G | 58, 24 |
| | | 244, 82 | 99-25961/376 | A/C | 44, 35 |
| | | 254, 70 | 99-25966/241 | A/G | 66, 18 |
| | | 257, 85 | 99-25967/57 | A/G | 42, 44 |
| | | 261, 23 | 99-25969/200 | G/T | 35, 76 |
| | | 263, 67 | 99-25979/93 | A/G | 67, 15 |
| | | 269, 39 | 99-25989/398 | A/G | 35, 88 |
| | Region D second Half | 299, 02 | 99-25993/367 | A/G | 47, 38 |
| | | 303, 04 | 99-16047/115 | C/T | 69, 01 |
| | | 335, 02 | 99-15875/165 | C/T | 61, 3 |
| | | 354, 81 | 99-16033/244 | C/T | 50, 3 |
| | | 366, 51 | 99-16032/292 | A/C | 62, 87 |
| | | 367, 14 | 99-25940/182 | A/G | 54, 39 |
| | | 372, 98 | 99-15880/162 | A/G | 62, 72 |
| | | 375, 28 | 99-16038/118 | A/G | 37, 29 |
| | | 383, 41 | 99-15870/400 | A/G | 29, 65 |
| | | 394, 16 | 99-24649/186 | C/T | 66, 57 |

TABLE 15-continued

| REGION | CONTIG | POSITION ON CONTIG | SNPS GENOTYPED | POLYMORPHISM | FREQUENCY IN CONTROLS |
|---|---|---|---|---|---|
| | | 395, 27 | 99-5897/143 | A/C | 52, 6 |
| | | 409, 93 | 99-24644/194 | A/G | 38, 29 |
| | | 424, 95 | 99-5919/215 | A/G | 60, 63 |
| | | 441, 62 | 99-5862/167 | C/T | 46, 53 |
| | | 444, 00 | 99-16100/147 | A/G | 48, 84 |
| | | 445, 84 | 99-7652/162 | A/G | 49, 7 |
| | Region D second Half | | | | |
| TOTAL | | | 30 | | |

(1): frequency (%) in caucasian controls (N=177) of the first allele (alphabetic order) Region D was arbitrarily split in two halves (D $1^{st}$ half and D $2^{nd}$ half) for purpose of the analysis.

The present inventors have previously demonstrated significant association of biallelic markers located on the Region D subregion of the human chromosome 13q31–33 region with disease. Using a set of 30 biallelic markers shown in Table 15, D $1^{st}$ half contained 14 markers and D $2^{nd}$ half contained 16 markers.

Table 15 also shows the physical order of the biallelic markers on Region D of the human chromosome 13q31–q33 region. The mean intermarker distances of the biallelic markers on the first and the second subjective portions of Region D were as listed below in Table 16.

TABLE 16

| Region | Mean Inter-marker distance (std) |
|---|---|
| D $1^{st}$ half | 7.80 (6.33) |
| D $2^{nd}$ half | 9.79 (8.78) |
| D $1^{st}$ and $2^{nd}$ half | 9.58 (8.46) |

The analysis using selected Region D biallelic markers of the invention demonstrated a significant association with bipolar disorder for the second portion of Region D. The analysis was conducted using the sample population described above with 182 caucasian cases and 177 caucasian controls selected from the total case and control group.

One biallelic marker in particular, 99-15875/165(A68), located on the second half of Region D, demonstrated a significant association with disease at a significance level of better than 5% (corresponding to an absolute logarithm (p-value) of 1.3).

B) Haplotype Association Results in Bipolar Disorder Cases

Haplotype analysis for association of chromosome 13q31–q33-related biallelic markers and bipolar disorder was performed by estimating the frequencies of all possible 2, 3 and 4 marker haplotypes in the affected and control populations described above. Haplotype frequencies estimations were performed by applying the Expectation-Maximization (EM) algorithm (Excoffier and Slatkin, 1995), modified by Nicholas Schork.

Significant results were obtained in haplotype studies indicating an association of the nucleotide sequences of the invention with bipolar disorder. The haplotype analysis as shown in the FIGS. 9A, 9B, 10A, 10B, 11A and 11B was conducted using the sample population described above, using 182 Caucasian cases and 177 Caucasian controls selected from the total case and control group.

Using the Omnibus LR test which compares the profile of haplotype frequencies, and Haplo-maxM test which is based on haplotype frequencies differences for each haplotype in two groups, FIGS. 9A, 9B, 10A, 10B, 11A and 11B show the results of a comparison of the first and second portions of Region D which demonstrated an association of the second portion of Region D with bipolar disorder.

a—Omnibus LR Tests Values

For a given combination of 2, 3 or 4 biallelic markers, one likelihood ratio test (LR test) is obtained based on the haplotype frequencies values calculated using the E-M algorithm.

FIGS. 9A and 9B show a comparison of the LR test value distributions of haplotype frequencies in the two portions of Region D. This association of the second portion of Region D with bipolar disorder is shown using both 2-marker and 3-marker combinations. A Kruskall Wallis rank test was used to compare LR test values distributions in the two subjective portions of Region D. This test has an asymptotic Chi-square distribution, under the null hypothesis of no difference between the sets compared, with (r−1) degrees of freeedom, where r represents the number of sets compared. Here, we compare the 2 portions of region D, so r=2, and the asymptotic Chi-square distribution has 1 degree of freedom. As shown, the significance of the association is demonstrated by a chi-square value (one degree of freedom) of 46.62 and a p-value of $8.62 \times 10^{-12}$ for 2 marker combinations, and a chi-square value (one degree of freedom) of 124.72 and a p-value of $5.86 \times 10^{-29}$ for 3-marker combinations.

b—Haplo-max Tests Values

Another association analysis approach based on haplotype frequencies differences, referred to as the Haplo-max test, was conducted using region D biallelic markers. The haplo-max test selects the difference showing the maximum positive (maxM) or negative (maxS) test value between cases versus controls (rejecting test values based on rare haplotype frequencies, i.e, with an estimated number of haplotypes carriers inferior to 10); for one combination of markers there is therefore one Max-M and one Max-S test values.

FIGS. 10A and 10B show the distribution of haplo-maxM test values obtained for both 2-marker and 3-marker combinations in the two portions of Region D, demonstrating an association of the second portion of Region D with bipolar disorder. The comparison of the distribution of Haplo-maxM test values in the two regions was analyzed using a Kruskal-Wallis rank test, a chi-square test with 1 degree of freedom. As shown, the significance of the association is demonstrated by a chi-square value of 29.07 and a p-value $6.98 \times 10^{-8}$ for 2 marker combinations, and a chi-square value of 98.63 and a p-value of $3.04 \times 10^{-23}$ for 3- marker combinations.

FIGS. 11A and 11B show the distribution of Haplo-maxS test values again obtained for all 2-marker and 3-marker combinations in the two portions of Region D, demonstrating an association of the second portion of Region D with bipolar disorder. The comparison of the distributions of Haplo-maxS test values in the two portions was analyzed using a Kruskal-Wallis rank test with one degree of freedom. As shown, the significance of the association is demonstrated by a chi-square value of 34.6 and a p-value of $4.05 \times 10^{-9}$ for 2 marker combinations, and a chi-square value of 98.31 and a p-value of $3.58 \times 10^{-23}$ for 3-marker combinations.

The results from the haplo-maxM and haplo-maxS tests thus further confirm the association shown using the Omnibus LR test results.

Example 5e

Identification of Common Haplotypes in Three Schizophrenia Populations

Based on the results above indicating an association of biallelic markers located in Region D3 with schizophrenia, further biallelic markers in Region D3 were screened in three different populations of schizophrenia cases and controls. The D3 region is an approximately 150 kb genomic region containing the g35030 gene.

Several significant haplotypes comprised of markers in or flanking the g35030 gene and common to the three populations were identified. These haplotypes demonstrated significance in Omnibus LR and individual haplotype frequency tests. Furthermore, the estimated frequencies of the haplotypes were highly similar for each of the different populations.

The samples used were obtained from a French Canadian population, an Eastern European population, and a United States sample. The French Canadian schizophrenia sample is described above in Example 5a, and Tables 7 and 8. The United States schizophrenia sample is described in Table 17 below. The Eastern European sample, is described in Table 18 below.

TABLE 17

| United States Schizophrenia Cases and Control Populations (United States Caucasians) Sample type Sample size | Cases 131 | Random US Controls 188 |
|---|---|---|
| Ethnic origin | | |
| European Causasians (26 female, 66 male) | 92 | |
| Ashkenazi caucasians (7 female, 17 female) | 24 | |
| Other Caucasians (7 female, 8 male) | 15 | |

TABLE 17-continued

| United States Schizophrenia Cases and Control Populations (United States Caucasians) Sample type Sample size | Cases 131 | Random US Controls 188 |
|---|---|---|
| Familial history of psychosis (FH) | | |
| positive (FH+) | 133 | |
| none (FH−) | 147 | 198 |

TABLE 18

| Eastern European (Rogaev) Schizophrenia Cases and Control Populations Sample type Sample size | Cases 183 | Controls 183 |
|---|---|---|
| Ethnic origin: European Causasians (97 female, 86 male) Familial history of psychosis (FH) | | |
| positive (FH+) | 55 | |
| none (FH−) | 128 | |

For each of the three populations, multipoint analyses were carried out using biallelic markers from the D3 region. The haplotypic frequency differences between case and controls was examined, reported as MaxM for the maximum positive difference, and MaxS as the maximum negative difference, and the profile of haplotype frequency differences, where the distribution of haplotype frequency differences is described using the Omnibus LR test.

Several significant two-marker haplotypes were found to be in common among the three populations. One haplotype, referred to haplotype 2, is described further in Tables 19 and 20. Other haplotypes are comprised of biallelic markers which are in linkage disequilibrium with one of the biallelic markers of haplotype 2, and thus also provide significant results. Biallelic markers 99-15875-165 (A68) (allele T) and 99-5862-167, involved in haplotype 2, demonstrated a range of estimation of haplotype frequencies of 23.6 to 24.5 in cases, and 15.5 to 17.6 in controls. Again, similar differences in frequency estimates were seen with other haplotypes. Markers 99-15875-165 (A68) (allele T) and 99-5862-167 are located in or flanking the g35030 gene.

Table 19 shows the results of analysis of estimated haplotype frequencies for haplotype 2, comprising biallelic markers 99-15875-165 (A68) (allele T) and 99-5862-167 (A10) (allele T.). Presented are the results of a likelihood ratio test (LR test), demonstrating a significant p-value in each of the three populations; the results of the LR test on which a permutation procedure has been carried out (Omnibus), demonstrating a significant p-value of $5*10-3$ for French Canadian samples, $8*10-2$ for Eastern European (Rogaev) samples, and $1*10-2$ for U.S. samples; and the estimated haplotype frequencies in cases and controls, and their positive or negative difference (MaxM). Notably, the haplotype frequencies in the three populations are highly similar at 23.60, 23.90 and 24.50 for cases and 15.5, 17.6 and 15.5 for controls.

TABLE 19

HAP2:
99-15875/165 (T), 99-5862/167 (T)

| POP | haplotype | Pvalue-hap | Omnibus (1000 perm) | freq cas | freq controls | Difference | |
|---|---|---|---|---|---|---|---|
| French Canadian | TT (LD Normalized:−0.16) | 2,20E-03 | 5,00E-03 | 23, 60 | 15, 5 | 8, 10 | MaxM |
| Eastern European | | 4,60E-02 | 8,70E-02 | 23, 90 | 17, 6 | 6, 3 | MaxM |
| U.S. | | 8,60E-03 | 1,30E-02 | 24, 50 | 15, 5 | 9 | MaxM |

Example 6

Preparation of Antibody Compositions to the g35030 Protein

Substantially pure protein or polypeptide is isolated from transfected or transformed cells containing an expression vector encoding the g35030 protein or a portion thereof. The concentration of protein in the final preparation is adjusted, for example, by concentration on an Amicon filter device, to the level of a few micrograms/ml. Monoclonal or polyclonal antibody to the protein can then be prepared as follows:

A. Monoclonal Antibody Production by Hybridoma Fusion

Monoclonal antibody to epitopes in the g35030 protein or a portion thereof can be prepared from murine hybridomas according to the classical method of Kohler, G. and Milstein, C., Nature 256:495 (1975) or derivative methods thereof. Also see Harlow, E., and D. Lane. 1988. Antibodies A Laboratory Manual. Cold Spring Harbor Laboratory. pp. 53–242.

Briefly, a mouse is repetitively inoculated with a few micrograms of the g35030 protein or a portion thereof over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as ELISA, as originally described by Engvall, (1980), and derivative methods thereof. Selected positive clones can be expanded and their monoclonal antibody product harvested for use. Detailed procedures for monoclonal antibody production are described in Davis, L. et al. Basic Methods in Molecular Biology Elsevier, New York. Section 21-2.

B. Polyclonal Antibody Production by Immunization

Polyclonal antiserum containing antibodies to heterogeneous epitopes in the g35030 protein or a portion thereof can be prepared by immunizing suitable non-human animal with the g35030 protein or a portion thereof, which can be unmodified or modified to enhance immunogenicity. A suitable non-human animal is preferably a non-human mammal is selected, usually a mouse, rat, rabbit, goat, or horse. Alternatively, a crude preparation which has been enriched for g35030 concentration can be used to generate antibodies. Such proteins, fragments or preparations are introduced into the non-human mammal in the presence of an appropriate adjuvant (e.g. aluminum hydroxide, RIBI, etc.) which is. known in the art. In addition the protein, fragment or preparation can be pretreated with an agent which will increase antigenicity, such agents are known in the art and include, for example, methylated bovine serum albumin (mBSA), bovine serum albumin (BSA), Hepatitis B surface antigen, and keyhole limpet hemocyanin (KLH). Serum from the immunized animal is collected, treated and tested according to known procedures. If the serum contains polyclonal antibodies to undesired epitopes, the polyclonal antibodies can be purified by immunoaffinity chromatography.

Effective polyclonal antibody production is affected by many factors related both to the antigen and the host species. Also, host animals vary in response to site of inoculations and dose, with both inadequate or excessive doses of antigen resulting in low titer antisera. Small doses (ng level) of antigen administered at multiple intradermal sites appears to be most reliable. Techniques for producing and processing polyclonal antisera are known in the art, see for example, Mayer and Walker (1987). An effective immunization protocol for rabbits can be found in Vaitukaitis, J. et al. J. Clin. Endocrinol. Metab. 33:988–991 (1971).

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, O. et al., (1973). Plateau concentration of antibody is usually in the range of 0.1 to 0.2 mg/ml of serum (about 12 $\mu$M). Affinity of the antisera for the antigen is determined by preparing competitive binding curves, as described, for example, by Fisher, D., Chap. 42 in: Manual of Clinical Immunology, 2d Ed. (Rose and Friedman, Eds.) Amer. Soc. For Microbiol., Washington, D.C. (1980).

Antibody preparations prepared according to either the monoclonal or the polyclonal protocol are useful in quantitative immunoassays which determine concentrations of antigen-bearing substances in biological samples; they are also used semi-quantitatively or qualitatively to identify the presence of antigen in a biological sample. The antibodies may also be used in therapeutic compositions for killing cells expressing the protein or reducing the levels of the protein in the body.

The disclosures of all issued patents, published PCT applications, scientific references or other publications cited herein are incorporated herein by reference in their entireties.

Although this invention has been described in terms of certain preferred embodiments, other embodiments which will be apparent to those of ordinary skill in the art of view of the disclosure herein are also within the scope of this invention. Accordingly, the scope of the invention is intended to be defined only by reference to the appended claims.

The disclosures of the following references are incorporated herein by reference in their entireties:

Abbondanzo S. J. et al. (1993) Methods in Enzymology, Academic Press, N.Y. pp. 803–823.
Ajioka R. S. et al. (1997) Am. J. Hum. Genet.60:1439–1447.
Altschul et al., 1990, J. Mol. Biol. 215(3):403–410;
Altschul et al., 1993, Nature Genetics 3:266–272
Altschul et al.,1997, Nuc. Acids Res. 25:3389–3402
Ames, R. S. et al. J. Immunol. Methods 184:177–186(1995)
Anton M. et al., 1995, J. Virol.,69: 4600–4606.
Araki K et al. (1995) Proc. Natl. Acad. Sci. USA. 92(1):160–4.
Ashkenazi, A. et al. PNAS 88:10535–10539(1991)
Ausubel et al. (1989)Current Protocols in Molecular Biology, Green Publishing Associates and Wiley Interscience,N.Y.
Bartunek, P. et al. Cytokine 8(1):14–20 (1996)
Baubonis W. (1993) Nucleic Acids Res. 21(9):2025–9.
Beaucage et al., Tetrahedron Lett 1981, 22: 1859–1862
Better, M. et al. Science 240:1041–1043(1988)
Bradley A.,(1987) Production and analysis of chimaeric mice. In:E. J. Robertson(Ed.), Teratocarcinomas and embryonic stem cells: A practical approach.IRL Press, Oxford, pp. 113.
Brinkman U. et al. J. Immunol. Methods 182:41–50(1995)
Brown E L, Belagaje R, Ryan M J, Khorana H G, Methods Enzymol 1979;68:109–151
Brutlag et al. Comp. App.Biosci. 6:237–245, 1990
Burton, D. R. et al. Advances in Immunology 57:191–280 (1994)
Carlson, N. G. et al. J. Biol. Chem. 272(17):11295–11301 (1997)
Chai H. et al. (1993) Biotechnol. Appl.Biochem.18:259–273.
Chee et al. (1996) Science. 274:610–614.
Chen and Kwok Nucleic Acids Research 25:347–353 1997
Chen et al.(1987) Mol. Cell. Biol. 7:2745–2752.
Chen et al., 1987, Mol. Cell.Biol., 7: 2745–2752.
Chen, Z. et al. Cancer Res. 58(16): 3668–3678(1998)
Chou J. Y. (1989)Mol. Endocrinol.3:1511–1514.
Clark A. G. (1990)Mol. Biol. Evol. 7:111–122.
Coles et al. Hum. Mol. Genet., 7:791–800, 1998
Compton J. (1991)Nature. 350(6313):91–92.
Davis et al., Basic Methods in MolecularBiology, ed., Elsevier Press, N.Y., 1986
Dempster et al., (1977) J. R. Stat. Soc., 39B:1–38.
Deng, B. et al. Blood 92(6): 1981–1988(1998)
Dent D. S. and Latchman D. S. (1993) The DNA mobility shift assay. In: Transcription Factors: A Practical Approach (Latchman D S, ed.) Oxford: IRL Press. pp1–26.
Eckner R. et al. (1991)EMBO J. 10:3513–3522.
Excoffier L. and Slatkin M.(1995) Mol. Biol. Evol., 12(5): 921–927.
Feldman and Steg, 1996,Medecine Sciences, synthese, 12:47–55
Fell, H. P. et al. J. Immunol. 146:2446–2452(1991)
Flotte et al. (1992) Am. J.Respir. Cell Mol. Biol. 7:349–356.
Fodor et al. (1991) Science251:767–777.
Fraley et al. (1979) Proc. Natl. Acad. Sci. USA.76:3348–3352.
Fried M. and Crothers D. M. (1981) Nucleic Acids Res.9:6505–6525.
Fuller S. A. et al. (1996) Immunology in CurrentProtocols in Molecular Biology, Ausubel et al. Eds, John Wiley & Sons,Inc., USA.
Furth P. A. et al. (1994) Proc. Natl. Acad. Sci USA.91 :9302–9306.
Garner M. M. and Revzin A. (1981) Nucleic AcidsRes.9:3047–3060.
Geysen H. Mario et al. 1984. Proc. Natl. Acad.Sci. U.S.A. 81:3998–4002
Ghosh and Bacchawat (1991) Targeting ofliposomes to hepatocytes, IN: Liver Diseases,
Targeted diagnosis and therapy using specific receptors and ligands. Wu et al.Eds., MarcelDekeker, New York, pp. 87–104.
Gillies, S. D. et al. J. Immunol. Methods 125:191–202(1989)
Gillies, S. O. et al. PNAS 89:1428–1432(1992)
Gonnet et al., 1992, Science256:1443–1445;
Gopal(1985)Mol. Cell. Biol.,5:1188–1190.
Gossen M. et al. (1992)Proc. Natl. Acad. Sci. USA.89:5547–5551.
Gossen M. et al. (1995) Science. 268:1766–1769.
Graham et al. (1973) Virology 52:456–457.
Green et al. (1986)Ann. Rev. Biochem. 55:569–597.
Greenspan and Bona, FASEB J. 7(5):437–444 (1989)
Griffin et al.( 1989) Science.245 :967–971.
Grompe, M. (1993) Nature Genetics. 5:111–117.
Grompe, M. et al. (1989) Proc. Natl. Acad. Sci. U.S.A.86:5855–5892.
Gu H. et al. (1993) Cell 73:1155–1164.
Guatelli J C et al. Proc. Natl. Acad. Sci. USA. 35:273–286.
Hacia J G, Brody L C, Chee M S, Fodor S P, Collins F S, Nat Genet1996;14(4):441–447
Haff L. A. and Smirnov I. P. (1997) GenomeResearch, 7:378–388.
Hames B. D. and Higgins S. J. (1985) Nucleic Acid Hybridization: A Practical Approach. Hames and Higgins Ed., IRL Press, Oxford.
Hammerling, et al., in: MONOCLONAL ANTIBODIES AND T-CELL HYBRIDOMAS 563–681 (Elsevier, N.Y., 1981)
Harju L, Weber T, Alexandrova L, Lukin M, Ranki M, Jalanko A, Clin Chem 1993;39(11 Pt 1):2282–2287
Harland et al.(1985) J. Cell. Biol. 101:1094–1095.
Harrop, J. A. et al. J. Immunol. 161(4): 1786–1794(1998)
Hawley M. E. et al. (1994) Am.J. Phys. Anthropol. 18:104.
Henikoff and Henikoff, 1993, Proteins17:49–61
Higgins et al., 1996, Methods Enzymol. 266:383–402;
Hillier L. and Green P. MethodsAppl., 1991, 1: 124–8. GuH. et al.(1994) Science265:103–106.
Hoess et al. (1986) Nucleic AcidsRes. 14:2287–2300.
Huang L. et al. (1996) Cancer Res56(5):1137–1141.
Huston et al. Methods in Enzymology 203:46–88(1991)
Huygen et al. (1996) Nature Medicine.2(8):893–898.
Izant J. G. and Weintraub H. (1984) Cell 36(4):1007–1015.
Julan et al. (1992)J. Gen. Virol. 73:3251–3255.
Kanegae Y. et al., Nucl. Acids Res. 23:3816–3821.
Karlin and Altschul, 1990, Proc. Natl. Acad. Sci. USA 87:2267–2268;
Kettleborough, C. A. et al. Eur. J. Immunol. 24:952–958 (1994)
Khoury J. et al. (1993) Fundamentals of Genetic Epidemiology, Oxford University Press, NY.
Kim U-J. et al. (1996) Genomics 34:213–218.
Kleinet al. (1987) Nature. 327:70–73.
Koller et al. (1992) Annu. Rev. Immunol. 10:705–730.
Kozal M J, Shah N, Shen N, Yang R, Fucini R, Merigan T C, Richman D D, Morris D, Hubbell E, Chee M, Gingeras T R, Nat Med 1996;2(7):753–759
Landegren U. et al. (1998) GenomeResearch, 8:769–776.
Lander and Schork, Science, 265; 2037–2048,1994

Lenhard T. et al. (1996) Gene. 169:187–190.
Liautard, J. et al. Cytokinde 9(4):233–241(1997)
Linton M. F. et al. (1993) J. Clin. Invest. 92:3029–3037.
Liu Z. et al. (1994)Proc. Natl. Acad. Sci. USA. 91: 4528–4262.
Livak et al., Nature Genetics, 9:341–342, 1995
Livak K J, Hainer J W, Hum Mutat1994;3(4):379–385
Lockhart et al.(1996) Nature Biotechnology14:1675–1680.
Mansour S. L. et al. (1988) Nature. 336:348–352.
Marshall R. L. et al. (1994) PCR Methods and Applications.4:80–84.
McCormick et al. (1994)Genet. Anal. Tech. Appl.11:158–164.
McLaughlin B. A. et al. (1996) Am. J. Hum. Genet.59:561–569.
Morton N. E. (1955)Am. J. Hum. Genet. 7:277–318.
Morrison, Science 229:1202 (1985)
Muller, Y. A. et al. Structure 6(9):1153–1167(1998)
Mullinax, R. L. et al. BioTechniques 12(6):864–869(1992)
Muzyczka et al. (1992) Curr. Topics in Micro. and Immunol.158:97–129.
Padlan E. A., Molecular Immunology 28(4/5): 489–498 (1991)
Nada S. et al. (1993) Cell 73:1125–1135.
Nagy A. et al. (1993) Proc. Natl. Acad. Sci. USA. 90: 8424–8428.
Naramura, M. et al. Immunol. Lett. 39:91–99(1994)
Narang S A, Hsiung H M, Brousseau R, Methods Enzymol 1979;68:90–98
Neda et al. (1991)J. Biol. Chem. 266:14143–14146.
Newton et al. (1989)Nucleic Acids Res. 17:2503–2516.
Nickerson D. A. et al. (1990)Proc. Natl. Acad. Sci. U.S.A. 87:8923–8927.
Nicolau et al.(1982)Biochim. Biophys. Acta. 721:185–190.
Nissinoff, J. Immunol. 147(8): 2429–2438 (1991).
Nyren P, Pettersson B, Uhlen M, Anal Biochem 1993;208 (1):171–175
O'Reilly et al. (1992)Baculovirus Expression Vectors: A Laboratory Manual. W. H. Freeman and Co., New York.
Ohno et al. (1994) Science. 265:781–784.
Oi et al., BioTechniques 4:214 (1986)
Orita et al. (1989) Proc. Natl. Acad. Sci. U.S.A.86: 2776–2770.
Ott J. (1991) Analysis of Human Genetic Linkage. John Hopkins University Press, Baltimore.
Pastinen et al., Genome Research 1997; 7:606–614
Pearson and Lipman, 1988, Proc. Natl. Acad. Sci. USA 85(8):2444–2448;
Pease S. and William R. S. (1990) Exp. Cell. Res. 190:09–211.
Perlin et al. (1994) Am. J. Hum. Genet. 55:777–787.
Persic, L. et al. Gene 187 9–18(1997)
Peterson et al.(1993) Proc. Natl. Acad. Sci. USA. 90: 7593–7597.
Pietu et al.(1 996) Genome Research.6:492–503.
Pitard, V. et al. J. Immunol. Methods 205(2):177–190(1997)
Potter et al. (1984)Proc. Natl. Acad. Sci. U.S.A. 81(22):7161–7165.
Prat, M. et al. J. Cell. Sci. 111(Pt2): 237–247(1998)
Rayl et al., (1996) J. Bio.Chem, 271, 2225–2233.
Reid L. H. et al. (1990) Proc. Natl. Acad. Sci. U.S.A. 87:4299–4303.
Risch, N. and Merikangas, K. (1996)Science. 273:1516–1517.
Robertson E. (1987) "Embryo-Derived StemCell Lines." In: E. J. Robertson Ed. Teratocarcinomas And Embrionic Stem Cells: A Practical Approach. IRL Press, Oxford, pp. 71.
Roguska M. A. et al. PNAS 91:969–973), (1994)
Rossi et al. (1991) Pharmacol. Ther. 50:245–254.
Roth J. A. et al. (1996)Nature Medicine. 2(9):985–991.
Roux et al. (1989)Proc. Natl. Acad.Sci. U.S.A. 86:9079–9083.
Ruano et al. (1990)Proc. Natl. Acad.Sci. U.S.A. 87:6296–6300.
Sambrook,.J., Fritsch, E. F., and T. Maniatis. (1989) Molecular Cloning: A Laboratory Manual. 2ed. ColdSpring Harbor Laboratory, Cold Spring Harbor, N.Y.
Samson M, et al. (1996) Nature, 382(6593):722–725.
Samulski et al. (1989) J.Virol. 63:3822–3828.
Sanchez-Pescador R. (1988) J. Clin. Microbiol. 26(10):1934–1938.
Sarkar, G. and Sommer S. S. (1991)Biotechniques.
Sauer B. et al. (1988)Proc. Natl. Acad. Sci. U.S.A. 85:5166–5170.
Sawai, H. et al. AJRI 34:26–34(1995)
Schaid D. J. et al. (1996) Genet. Epidemiol.13:423–450.
Schedl A. et al. (1993a) Nature. 362:258–261.
Schedl et al. (1993b) Nucleic Acids Res. 21:4783–4787.
Schedl et al. (1993b) Nucleic Acids Res. 21:4783–4787.
Schena et al. (1995)Science. 270:467–470.
Schena et al. (1996) Proc. Natl. Acad. Sci.U.S.A. 93(20):10614–10619.
Schneider et al.(1997) Arlequin: A Software For Population Genetics Data Analysis. University of Geneva.
Schwartz and Dayhoff, eds., 1978, Matrices for Detecting DistanceRelationships: Atlas of Protein Sequence and Structure, Washington:National Biomedical Research Foundation
Sczakiel G. et al. (1995)Trends Microbiol. 3(6):213–217.
Shay J. W. et al. (1991) Biochem.Biophys. Acta. 1072:1–7.
Sheffield, V. C. et al. (1991)Proc.Natl. Acad. Sci. U.S.A. 49:699–706.
Shizuya et al. (1992) Proc.Natl. Acad. Sci. U.S.A. 89:8794–8797.
Shoemaker D D, Lashkari D A, Morris D, Mittmann M, Davis R W, Nat Genet 1996;14(4):450–456
Shu, L. et al. PNAS 90:7995–7999(1993)
Skerra, A. et al. Science 240:1038–1040. (1988)
Smith(1957) Ann. Hum. Genet. 21:254–276.
Smith et al. (1983) Mol. Cell.Biol. 3:2156–2165.
Sosnowski R. G. et al. (1997) Proc. Natl. Acad.Sci. U.S.A. 94:1119–1123.
Spielmann S. and Ewens W. J. (1998) Am. J.Hum. Genet. 62:450–458.
Spielmann S. et al. (1993) Am. J. Hum.Genet. 52:506–516.
Sternberg N. L. (1992) Trends Genet. 8:1–16.
Sternberg N. L. (1994) Mamm. Genome. 5:397–404.
Studnicka G. M. et al. Protein Engineering 7(6):805–814 (1994)
Syvanen A C, ClinChim Acta 1994;226(2):225–236
Tacson et al. (1996) NatureMedicine. 2(8):888–892.
Taryman, R. E. et al. Neuron 14(4):755–762(1995)
Te Riele et al. (1990) Nature.348:649–651.
Terwilliger J. D. and Ott J. (1994) Handbook of HumanGenetic Linkage. John Hopkins University Press, London.
Thomas K. R. et al. (1986) Cell. 44:419–428.
Thomas K. R. et al. (1987)Cell. 51:503–512.
Thompson et al., 1994, Nucleic Acids Res.22(2):4673–4680;
Tur-Kaspa et al. (1986) Mol. Cell. Biol.6:716–718.
Tyagi et al. (1998) Nature Biotechnology. 16:49–53.
Urdea M. S. (1988)Nucleic Acids Research. 11:4937–4957.
Urdea M. S. et al.(1991) Nucleic Acids Symp. Ser. 24:197–200.

Van derLugt et al. (1991) Gene. 105:263–267.
Vil, H. et al. PNAS 89:11337–11341(1992)
Vlasak R. et al. (1983)Eur. J. Biochem. 135:123–126.
Wabiko et al. (1986)DNA.5(4):305–314.
Walker et al. (1996) Clin. Chem. 42:9–13.
Weir, B. S. (1996) Genetic data Analysis II: Methods for Discretepopulation genetic Data, Sinauer Assoc., Inc., Sunderland, Mass., U.S.A.
White, M. B. et al. (1992) Genomics. 12:301–306.
White, M. B. et al. (1997) Genomics. 12:301–306.
Wong et al. (1980) Gene.10:87–94.
Wood S. A. et al. (1993)Proc. Natl. Acad. Sci. U.S.A.90:4582–4585.
Wu and Wu (1987) J. Biol. Chem. 262:4429–4432.
Wu and Wu (1988) Biochemistry. 27:887–892.
Wu et al. (1989)Proc. Natl. Acad. Sci. U.S.A. 86:2757.
Yagi T. et al. (1990) Proc.Natl. Acad. Sci. U.S.A. 87:9918–9922.
Yoon, D. Y. et al. J. Immunol. 160(7): 3170–3179(1998)
Zhao et al. (1998) Am.J. Hum. Genet. 63:225–240.
Zheng, X. X. et al. J. Immunol. 154:5590–5600(1995)
Zhu, Z. et al. Cancer Res. 58(15): 3209–3214(1998)
Zou Y. R. et al. (1994) Curr. Biol.4:1099–1103

SEQUENCE LISTING (134 sequences)

SEQ ID NO: 1 - DNA, 319608 bp, Homo sapiens
  misc_feature 199122..201122: 5'regulatory region
  exon 201123..201234: exon S
  exon 201123..201560: exon S2
  exon 214676..214793: exon T
  exon 215702..215746: exon U
  exon 216836..216994: exon V
  exon 216836..217077: exon V2
  exon 217671..217764: exon V1
  exon 227655..227736: exon V4
  exon 238715..238919: exon V3
  exon 240440..240673: exon W
  exon 240440..241153: exon W2
  exon 241072..241291: exon X
  exon 244353..244561: exon Y
  exon 246273..247802: exon Z
  misc_feature 247803..249803: 3'regulatory region
  allele 8316: 99-27943-150  : polymorphic base G or C
  allele 21672: 99-27935-193  : polymorphic base G or C
  allele 65485: 8-128-33  : polymorphic base C or T
  allele 95396: 99-31960-363  : polymorphic base A or G
  allele 107281: 99-24656-260  : polymorphic base A or G
  allele 160640: 99-24639-163  : polymorphic base A or C
  allele 160876: 99-24634-108  : polymorphic base A or T
  allele 168974: 99-7652-162  : polymorphic base A or G
  allele 170810: 99-16100-147  : polymorphic base A or G
  allele 173358: 99-5862-167  : polymorphic base A or G
  allele 189957: 99-5919-215  : polymorphic base A or G
  allele 197163: 99-24658-410  : polymorphic base A or G
  allele 200778: 8-303-235  : polymorphic base A or G
  allele 202651: 8-300-221  : polymorphic base A or G
  allele 202679: 8-300-193  : polymorphic base A or G
  allele 203378: 8-299-128  : polymorphic base A or T
  allele 204138: 8-296-213  : polymorphic base A or T
  allele 204605: 8-252-190  : polymorphic base C or T
  allele 204934: 99-24644-194  : polymorphic base A or G
  allele 205206: 8-295-248  : polymorphic base A or C
  allele 205329: 8-295-125  : polymorphic base C or T
  allele 206064: 8-293-130  : polymorphic base A or G
  allele 206545: 8-292-198  : polymorphic base A or G
  allele 207313: 8-251-322  : polymorphic base A or G
  allele 208285: 8-289-322  : polymorphic base A or G
  allele 208960: 8-287-249  : polymorphic base C or T
  allele 209123: 8-287-86  : polymorphic base A or T
  allele 209631: 8-285-319  : polymorphic base A or G
  allele 210361: 8-283-278  : polymorphic base G or C
  allele 210463: 8-283-176  : polymorphic base A or G
  allele 210486: 8-283-153  : polymorphic base G or C
  allele 210583: 8-283-56  : polymorphic base C or T
  allele 210879: 8-282-345  : polymorphic base G or C
  allele 210964: 8-282-260  : polymorphic base G or T
  allele 210979: 8-282-245  : polymorphic base A or C
  allele 211050: 8-282-174  : variable motif AAAGG or GAAGGAAGGAAGGAAGGAAGA
  allele 211132: 8-282-92  : polymorphic base A or T
  allele 211247: 8-281-367  : polymorphic base A or G
  allele 211315: 8-281-299  : polymorphic base A or G
  allele 211366: 8-281-248  : polymorphic base G or C
  allele 212520: 8-279-197  : polymorphic base A or C
  allele 212821: 8-278-289  : polymorphic base C or T
  allele 213833: 8-277-250  : polymorphic base C or T
  allele 214857: 8-124-294  : polymorphic base A or G
  allele 215347: 8-273-383  : polymorphic base A or G
  allele 216967: 8-126-286 or 8-130-143  : polymorphic base A or G
  allele 219540: 99-5897-143  : polymorphic base A or C
  allele 220836: 99-24649-186  : polymorphic base A or G
  allele 223230: 8-247-337  : polymorphic base A or G
  allele 224213: 8-246-393  : polymorphic base A or T
  allele 224792: 8-245-270  : polymorphic base A or G
  allele 230395: 8-119-247  : polymorphic base A or G
  allele 231677: 99-15870-400  : polymorphic base A or G
  allele 235315: 99-16087-219  : polymorphic base G or C
  allele 238789: 8-155-258  : polymorphic base C or T
  allele 239763: 8-136-267 or 99-16038-118 : polymorphic base C or T
  allele 241861: 99-15880-162  : polymorphic base A or G
  allele 243700: 8-271-227  : polymorphic base A or G
  allele 245264: 8-267-273  : deletion of GTGGGC
  allele 245663: 8-266-131  : polymorphic base A or C
  allele 245966: 8-265-208  : polymorphic base A or G
  allele 245971: 8-265-203  : polymorphic base G or C
  allele 247864: 99-25940-182  : polymorphic base C or T
  allele 248315: 99-16032-292  : polymorphic base G or T
  allele 255848: 99-16105-152  : polymorphic base A or G
  allele 260099: 99-16033-244  : polymorphic base A or G
  allele 279789: 99-15875-165  : polymorphic base C or T
  allele 300365: 99-16052-214  : polymorphic base A or G
  allele 312030: 99-16047-115  : polymorphic base A or G
  allele 316014: 99-25993-367  : polymorphic base A or G
  primer_bind 7938..7958: 99-27943.rp
  primer_bind 8446..8465: 99-27943.pu complement
  primer_bind 21365..21385: 99-27935.rp
  primer_bind 21845..21864: 99-27935.pu complement
  primer_bind 65453..65471: 8-128.pu
  primer_bind 65856..65874: 8-128.rp  complement
  primer_bind 95034..95053: 99-31960.pu
  primer_bind 95543..95563: 99-31960.rp  complement
  primer_bind 107022..107040: 99-24656.pu
  primer_bind 107495..107513: 99-24656.rp  complement
  primer_bind 160279..160298: 99-24639.rp
  primer_bind 160770..160787: 99-24634.pu
  primer_bind 160785..160802: 99-24639.pu complement
  primer_bind 161240..161257: 99-24634.rp  complement
  primer_bind 168813..168830: 99-7652.pu
  primer_bind 169331..169351: 99-7652.rp  complement
  primer_bind 170666..170686: 99-16100.pu
  primer_bind 171153..171173: 99-16100.rp  complement
  primer_bind 173065..173085: 99-5862.rp
  primer_bind 173495..173514: 99-5862.pu complement
  primer_bind 189753..189771: 99-5919.pu
  primer_bind 190187..190207: 99-5919.rp  complement
  primer_bind 197116..197135: 99-24658.rp
  primer_bind 197555..197572: 99-24658.pu complement
  primer_bind 200587..200606: 8-303.rp
  primer_bind 200994..201012: 8-303.pu complement
  primer_bind 202440..202459: 8-300.rp
  primer_bind 202852..202871: 8-300.pu complement
  primer_bind 203061..203080: 8-299.rp
  primer_bind 203486..203505: 8-299.pu complement
  primer_bind 203943..203962: 8-296.rp
  primer_bind 204345..204362: 8-296.pu complement
  primer_bind 204373..204392: 8-252.rp
  primer_bind 204741..204758: 99-24644.pu
  primer_bind 204777..204794: 8-252.pu complement
  primer_bind 205034..205052: 8-295.rp
  primer_bind 205222..205240: 99-24644.rp  complement
  primer_bind 205435..205453: 8-295.pu complement
  primer_bind 205768..205786: 8-293.rp
  primer_bind 206175..206193: 8-293.pu complement
  primer_bind 206316..206333: 8-292.rp
  primer_bind 206725..206742: 8-292.pu complement
  primer_bind 207186..207205: 8-251.rp
  primer_bind 207616..207634: 8-251.pu complement
  primer_bind 208186..208205: 8-289.rp
  primer_bind 208588..208606: 8-289.pu complement
  primer_bind 208786..208805: 8-287.rp
  primer_bind 209189..209208: 8-287.pu complement
  primer_bind 209520..209539: 8-285.rp
  primer_bind 209931..209949: 8-285.pu complement
  primer_bind 210219..210237: 8-283.rp
  primer_bind 210620..210638: 8-283.pu complement
  primer_bind 210801..210820: 8-282.rp
  primer_bind 211182..211199: 8-281.rp
  primer_bind 211205..211223: 8-282.pu complement
  primer_bind 211596..211613: 8-281.pu complement
  primer_bind 212290..212309: 8-279.rp
  primer_bind 212662..212679: 8-278.rp
  primer_bind 212698..212716: 8-279.pu complement
  primer_bind 213091..213109: 8-278.pu complement
  primer_bind 213783..213803: 8-277.rp
  primer_bind 214062..214082: 8-277.pu complement
  primer_bind 214564..214581: 8-124.pu
  primer_bind 214965..214983: 8-124.rp  complement
  primer_bind 215310..215328: 8-273.rp
  primer_bind 215711..215729: 8-273.pu complement
  primer_bind 216683..216702: 8-130.rp
  primer_bind 216687..216704: 8-126.pu
  primer_bind 217082..217101: 8-126.rp  complement
  primer_bind 217091..217109: 8-130.pu complement
  primer_bind 219408..219425: 99-5897.pu
  primer_bind 219882..219899: 99-5897.rp  complement
  primer_bind 220505..220522: 99-24649.rp
  primer_bind 221004..221021: 99-24649.pu complement
  primer_bind 223011..223028: 8-247.rp
  primer_bind 223549..223566: 8-247.pu complement
  primer_bind 223962..223978: 8-246.rp
  primer_bind 224564..224581: 8-245.rp
  primer_bind 224588..224605: 8-246.pu complement
  primer_bind 225044..225061: 8-245.pu complement
  primer_bind 230210..230227: 8-119.rp
  primer_bind 230622..230641: 8-119.pu complement
  primer_bind 231278..231298: 99-15870.pu
  primer_bind 231729..231747: 99-15870.rp  complement
  primer_bind 235081..235101: 99-16087.rp
  primer_bind 235515..235533: 99-16087.pu complement
  primer_bind 238607..238626: 8-155.rp
  primer_bind 239029..239046: 8-155.pu complement
  primer_bind 239405..239425: 99-16038.rp
  primer_bind 239606..239624: 8-136.rp
  primer_bind 239862..239880: 99-16038.pu complement
  primer_bind 240012..240029: 8-136.pu complement
  primer_bind 241700..241717: 99-15880.pu
  primer_bind 242151..242171: 99-15880.rp  complement
  primer_bind 243484..243502: 8-271.rp
  primer_bind 243909..243926: 8-271.pu complement
  primer_bind 245105..245123: 8-267.rp
  primer_bind 245372..245389: 8-266.rp
  primer_bind 245518..245535: 8-267.pu complement
  primer_bind 245754..245772: 8-265.rp
  primer_bind 245775..245793: 8-266.pu complement
  primer_bind 246155..246173: 8-265.pu complement
  primer_bind 247513..247533: 99-25940.rp
  primer_bind 248023..248043: 99-25940.pu complement
  primer_bind 248204..248223: 99-16032.rp
  primer_bind 248588..248606: 99-16032.pu complement
  primer_bind 255697..255715: 99-16105.pu
  primer_bind 256133..256152: 99-16105.rp  complement
  primer_bind 259885..259902: 99-16033.rp
  primer_bind 260324..260342: 99-16033.pu complement
  primer_bind 279626..279644: 99-15875.pu
  primer_bind 280154..280173: 99-15875.rp  complement
  primer_bind 300153..300170: 99-16052.pu
  primer_bind 300660..300680: 99-16052.rp  complement
  primer_bind 311615..311632: 99-16047.rp
  primer_bind 312126..312144: 99-16047.pu complement
  primer_bind 315649..315668: 99-25993.pu
  primer_bind 316129..316147: 99-25993.rp  complement
  primer_bind 8297..8315: 99-27943-150.mis
  primer_bind 8317..8335: 99-27943-150.mis complement
  primer_bind 21653..21671: 99-27935-193.mis
  primer_bind 21673..21691: 99-27935-193.mis complement
  primer_bind 65466..65484: 8-128-33.mis
  primer_bind 65486..65504: 8-128-33.mis complement
  primer_bind 95377..95395: 99-31960-363.mis
  primer_bind 95397..95415: 99-31960-363.mis complement
  primer_bind 107262..107280: 99-24656-260.mis
  primer_bind 107282..107300: 99-24656-260.mis complement
  primer_bind 160621..160639: 99-24639-163.mis
  primer_bind 160641..160659: 99-24639-163.mis complement
  primer_bind 160857..160875: 99-24634-108.mis
  primer_bind 160877..160895: 99-24634-108.mis complement
  primer_bind 168955..168973: 99-7652-162.mis
  primer_bind 168975..168993: 99-7652-162.mis complement
  primer_bind 170791..170809: 99-16100-147.mis
  primer_bind 170811..170829: 99-16100-147.mis complement
  primer_bind 173339..173357: 99-5862-167.mis
  primer_bind 173359..173377: 99-5862-167.mis complement
  primer_bind 189938..189956: 99-5919-215.mis
  primer_bind 189958..189976: 99-5919-215.mis complement
  primer_bind 197144..197162: 99-24658-410.mis
  primer_bind 197164..197182: 99-24658-410.mis complement
  primer_bind 200759..200777: 8-303-235.mis
  primer_bind 200779..200797: 8-303-235.mis complement
  primer_bind 202632..202650: 8-300-221.mis
  primer_bind 202652..202670: 8-300-221.mis complement
  primer_bind 202660..202678: 8-300-193.mis
  primer_bind 202680..202698: 8-300-193.mis complement
  primer_bind 203359..203377: 8-299-128.mis
  primer_bind 203379..203397: 8-299-128.mis complement
  primer_bind 204119..204137: 8-296-213.mis
  primer_bind 204139..204157: 8-296-213.mis complement
  primer_bind 204586..204604: 8-252-190.mis
  primer_bind 204606..204624: 8-252-190.mis complement
  primer_bind 204915..204933: 99-24644-194.mis
  primer_bind 204935..204953: 99-24644-194.mis complement
  primer_bind 205187..205205: 8-295-248.mis
  primer_bind 205207..205225: 8-295-248.mis complement
  primer_bind 205310..205328: 8-295-125.mis
  primer_bind 205330..205348: 8-295-125.mis complement
  primer_bind 206045..206063: 8-293-130.mis
  primer_bind 206065..206083: 8-293-130.mis complement
  primer_bind 206526..206544: 8-292-198.mis
  primer_bind 206546..206564: 8-292-198.mis complement
  primer_bind 207294..207312: 8-251-322.mis
  primer_bind 207314..207332: 8-251-322.mis complement
  primer_bind 208266..208284: 8-289-322.mis
  primer_bind 208286..208304: 8-289-322.mis complement
  primer_bind 208941..208959: 8-287-249.mis
  primer_bind 208961..208979: 8-287-249.mis complement
  primer_bind 209104..209122: 8-287-86.mis
  primer_bind 209124..209142: 8-287-86.mis complement
  primer_bind 209612..209630: 8-285-319.mis
  primer_bind 209632..209650: 8-285-319.mis complement
  primer_bind 210342..210360: 8-283-278.mis
  primer_bind 210362..210380: 8-283-278.mis complement
  primer_bind 210444..210462: 8-283-176.mis
  primer_bind 210464..210482: 8-283-176.mis complement
  primer_bind 210467..210485: 8-283-153.mis
  primer_bind 210487..210505: 8-283-153.mis complement
  primer_bind 210564..210582: 8-283-56.mis
  primer_bind 210584..210602: 8-283-56.mis complement
  primer_bind 210860..210878: 8-282-345.mis
  primer_bind 210880..210898: 8-282-345.mis complement
  primer_bind 210945..210963: 8-282-260.mis
  primer_bind 210960..210978: 8-282-245.mis
  primer_bind 210965..210983: 8-282-260.mis complement
  primer_bind 210980..210998: 8-282-245.mis complement
  primer_bind 211113..211131: 8-282-92.mis
  primer_bind 211133..211151: 8-282-92.mis complement
  primer_bind 211228..211246: 8-281-367.mis
  primer_bind 211248..211266: 8-281-367.mis complement
  primer_bind 211296..211314: 8-281-299.mis
  primer_bind 211316..211334: 8-281-299.mis complement
  primer_bind 211347..211365: 8-281-248.mis
  primer_bind 211367..211385: 8-281-248.mis complement
  primer_bind 212501..212519: 8-279-197.mis
  primer_bind 212521..212539: 8-279-197.mis complement
  primer_bind 212802..212820: 8-278-289.mis
  primer_bind 212822..212840: 8-278-289.mis complement
  primer_bind 213814..213832: 8-277-250.mis
  primer_bind 213834..213852: 8-277-250.mis complement
  primer_bind 214838..214856: 8-124-294.mis
  primer_bind 214858..214876: 8-124-294.mis complement
  primer_bind 215328..215346: 8-273-383.mis
  primer_bind 215348..215366: 8-273-383.mis complement
  primer_bind 216948..216966: 8-126-286.mis
  primer_bind 216948..216966: 8-130-143.mis
  primer_bind 216968..216986: 8-126-286.mis complement
  primer_bind 216968..216986: 8-130-143.mis complement
  primer_bind 219521..219539: 99-5897-143.mis
  primer_bind 219541..219559: 99-5897-143.mis complement
  primer_bind 220817..220835: 99-24649-186.mis
  primer_bind 220837..220855: 99-24649-186.mis complement
  primer_bind 223211..223229: 8-247-337.mis
  primer_bind 223231..223249: 8-247-337.mis complement
  primer_bind 224194..224212: 8-246-393.mis
  primer_bind 224214..224232: 8-246-393.mis complement
  primer_bind 224773..224791: 8-245-270.mis
  primer_bind 224793..224811: 8-245-270.mis complement
  primer_bind 230376..230394: 8-119-247.mis
  primer_bind 230396..230414: 8-119-247.mis complement
  primer_bind 231658..231676: 99-15870-400.mis
  primer_bind 231678..231696: 99-15870-400.mis complement
  primer_bind 235296..235314: 99-16087-219.mis
  primer_bind 235316..235334: 99-16087-219.mis complement
  primer_bind 238770..238788: 8-155-258.mis
  primer_bind 238790..238808: 8-155-258.mis complement
  primer_bind 239744..239762: 8-136-267.mis
  primer_bind 239744..239762: 99-16038-118.mis
  primer_bind 239764..239782: 8-136-267.mis complement
  primer_bind 239764..239782: 99-16038-118.mis complement
  primer_bind 241842..241860: 99-15880-162.mis
  primer_bind 241862..241880: 99-15880-162.mis complement
  primer_bind 243681..243699: 8-271-227.mis
  primer_bind 243701..243719: 8-271-227.mis complement
  primer_bind 245644..245662: 8-266-131.mis
  primer_bind 245664..245682: 8-266-131.mis complement
  primer_bind 245947..245965: 8-265-208.mis
  primer_bind 245952..245970: 8-265-203.mis
  primer_bind 245967..245985: 8-265-208.mis complement
  primer_bind 245972..245990: 8-265-203.mis complement
  primer_bind 247845..247863: 99-25940-182.mis
  primer_bind 247865..247883: 99-25940-182.mis complement
  primer_bind 248296..248314: 99-16032-292.mis
  primer_bind 248316..248334: 99-16032-292.mis complement
  primer_bind 255829..255847: 99-16105-152.mis
  primer_bind 255849..255867: 99-16105-152.mis complement
  primer_bind 260080..260098: 99-16033-244.mis
  primer_bind 260100..260118: 99-16033-244.mis complement
  primer_bind 279770..279788: 99-15875-165.mis
  primer_bind 279790..279808: 99-15875-165.mis complement
  primer_bind 300346..300364: 99-16052-214.mis
  primer_bind 300366..300384: 99-16052-214.mis complement
  primer_bind 312011..312029: 99-16047-115.mis
  primer_bind 312031..312049: 99-16047-115.mis complement
  primer_bind 315995..316013: 99-25993-367.mis
  primer_bind 316015..316033: 99-25993-367.mis complement
  misc_binding 8304..8328: 99-27943-150.probe
  misc_binding 21660..21684: 99-27935-193.probe
  misc_binding 65473..65497: 8-128-33.probe
  misc_binding 95384..95408: 99-31960-363.probe
  misc_binding 107269..107293: 99-24656-260.probe
  misc_binding 160628..160652: 99-24639-163.probe
  misc_binding 160864..160888: 99-24634-108.probe
  misc_binding 168962..168986: 99-7652-162.probe
  misc_binding 170798..170822: 99-16100-147.probe
  misc_binding 173346..173370: 99-5862-167.probe
  misc_binding 189945..189969: 99-5919-215.probe
  misc_binding 197151..197175: 99-24658-410.probe
  misc_binding 200766..200790: 8-303-235.probe
  misc_binding 202639..202663: 8-300-221.probe
  misc_binding 202667..202691: 8-300-193.probe
  misc_binding 203366..203390: 8-299-128.probe
  misc_binding 204126..204150: 8-296-213.probe
  misc_binding 204593..204617: 8-252-190.probe
  misc_binding 204922..204946: 99-24644-194.probe
  misc_binding 205194..205218: 8-295-248.probe
  misc_binding 205317..205341: 8-295-125.probe
  misc_binding 206052..206076: 8-293-130.probe
  misc_binding 206533..206557: 8-292-198.probe
  misc_binding 207301..207325: 8-251-322.probe
  misc_binding 208273..208297: 8-289-322.probe
  misc_binding 208948..208972: 8-287-249.probe
  misc_binding 209111..209135: 8-287-86.probe
  misc_binding 209619..209643: 8-285-319.probe
  misc_binding 210349..210373: 8-283-278.probe
  misc_binding 210451..210475: 8-283-176.probe
  misc_binding 210474..210498: 8-283-153.probe
  misc_binding 210571..210595: 8-283-56.probe
  misc_binding 210867..210891: 8-282-345.probe
  misc_binding 210952..210976: 8-282-260.probe
  misc_binding 210967..210991: 8-282-245.probe
  misc_binding 211120..211144: 8-282-92.probe
  misc_binding 211235..211259: 8-281-367.probe
  misc_binding 211303..211327: 8-281-299.probe
  misc_binding 211354..211378: 8-281-248.probe
  misc_binding 212508..212532: 8-279-197.probe
  misc_binding 212809..212833: 8-278-289.probe
  misc_binding 213821..213845: 8-277-250.probe
  misc_binding 214845..214869: 8-124-294.probe
  misc_binding 215335..215359: 8-273-383.probe
  misc_binding 216955..216979: 8-126-286.probe
  misc_binding 216955..216979: 8-130-143.probe
  misc_binding 219528..219552: 99-5897-143.probe
  misc_binding 220824..220848: 99-24649-186.probe
  misc_binding 223218..223242: 8-247-337.probe
  misc_binding 224201..224225: 8-246-393.probe
  misc_binding 224780..224804: 8-245-270.probe
  misc_binding 230383..230407: 8-119-247.probe
  misc_binding 231665..231689: 99-15870-400.probe
  misc_binding 235303..235327: 99-16087-219.probe
  misc_binding 238777..238801: 8-155-258.probe
  misc_binding 239751..239775: 8-136-267.probe
  misc_binding 239751..239775: 99-16038-118.probe
  misc_binding 241849..241873: 99-15880-162.probe
  misc_binding 243688..243712: 8-271-227.probe
  misc_binding 245651..245675: 8-266-131.probe
  misc_binding 245954..245978: 8-265-208.probe
  misc_binding 245959..245983: 8-265-203.probe
  misc_binding 247852..247876: 99-25940-182.probe
  misc_binding 248303..248327: 99-16032-292.probe
  misc_binding 255836..255860: 99-16105-152.probe
  misc_binding 260087..260111: 99-16033-244.probe
  misc_binding 279777..279801: 99-15875-165.probe
  misc_binding 300353..300377: 99-16052-214.probe
  misc_binding 312018..312042: 99-16047-115.probe
  misc_binding 316002..316026: 99-25993-367.probe
  misc_feature 4222,11245,27205..27206,27212..27213,27240,27347,27378,28258: n=a, g, c or t
cgggcgaattcgagctcggtacccggggatcatctttgtcatagattgtagtaaaaataatctgtgaaaagtgactgattattgacaggtagccttgggtatgcagctcaagtaggcattataaaataaaaaacatcacattccatgtattttcaaaaaaagcttctggcttactcaaaaggtaagtgttctttaaacaacttcaatggaaaaggagtttcttccaaatgcttggagaactccttctcaagtccggaataaagcaaggtctacagagacaaagtataaataaaaccatggtgctgagctggtaccactattgggctgctaagcactgctaagcattgccttcagatgagttacctagcctttgtaaagctcagattccacagctataaactgagatgaataataatacacaaaacactaagctgttgagtagattaaatgaaattatttatgtagagcaaatagaacagtactgtaccttataaaatttaaaaccaaaatgtaaattctgatttttacccaagggtcaactccgcacaattttgcaatggacccttccccggccctccagaagctgaatatcgttgtgtatcatatccaaattcagtatcaccagggcatagagtaagtgccaactgtgaggccatagctatgcgtccactcccctgaaacacattgtgtaccttcattcttggagttgagtctttgcatttcatcctccagagtgagaatagactgcgtgttggagaggtcagggaaattatgtctttctatgtctagccctttataggtcgattatttgaatgcttgacagcatctgtccacttatctatccctgcaataataaaatacgggactaaagtagctcgtatctctagtgggagagtgcatatattttatacgtcaattctttaaaaggggaaattctttcagagcttcagaaaatatcacggaagagttaaaagaatgtttgagaagaacatgtctgagtattacctactagcattacaattttactgctttaaagtaattataattttcattgcaggatctattaaaaaggcttttacctgacggtaattcttcttgtacttacaggtcattattacaatgaagggaagaaaggaagacatgaaggggaaatgggactatttaccaagtgtatctgcatagactaaaggagacaagaggaagtactgagcaccttgattcctgcagataattatttaagaaccataagaattctttcctagcttctcataagcctgctccttcaaagggtgagtagttgacatgattttacatcccatttatatttctttattagataattttatttcaaatctagtcttattttttctgaaccttctgggatatataacattttatattatcatttatgtcatcaagaatgtagatttatattcttttctattcacatgtttatgtaaataattgaacacctctaaatgacagatactatcattttatatattgttaataagtatcttcatggctgggcgtggtggctcacgcccgtaatcccagcactttgggaggccgaggtgggaggatcacctgaggtcaggagtttgagatcagcctggcgaacgtggtgaaatcccatctctactaaaaacaacaaaaattagctgggcatggtagcatgcgcctatagtcccagctactagggaggccaaggcaggagaatcgatcgctcaaacctgggaggcagaggtttcagtgagctgatatcgtgccactgcactctggcctgggcaacagaatgagaccctgcttcaataaataaataaattaattaattaattaataaagtatcttaatgacaaatatttaaatatatataaatatttacatttacatatgggaagagagatctgaaattttaagcaacttttatccaaaaacctatttttttcaaagttcctccaacatctataaaagaagtaaagtcacttatagatctatcttacttcagggcctatgttttcctctaccatacaacactgcacattcacagacacagaaatcttttacatttctaaaataaataaaacatccaaacttcagtttaaaaaaaatggatctacagatccaccatagactaaacgaccaaacatagtcagaggtgtttacttgtttgtttcggtcttaagggaatcttcaaactaccctagagcctcgtgtatccaatgagagcagtctggacattgaatgaatggtgatgtcattaaatgagctatggagcaagatgtaagaacacgctttagagtaaataacatatttggcttctgaggtataaaaagggaaggaggctttctcaggacatttgggtacctggtccttcatactcaggaggtttttccatcttcatgtcatggaataaactatgctttaaagaaatgctgcgtcagcagaaagtgtttcaaatataaggaaattgtcatagctttgaaattatgtcaaatatcattttaactaagagagccattgtctttccatatatttatctagaagaaaatttactggacaaaataaatatagaacaacttcatgtgtagtcattaatggtcggataggcagttactataaaatatgaataatctaaaaatcattttagccatttgtttttaataaatctcacttgtgattgatttattaaaaacagggcctccagaagaaagaaacttaatacctttcctccatcattatgaaggcactagtactgacgtaactaaaattagatggcagcttgagggaggaagagatgatgtagagatggtgtgtaatctgtgtaaacagtctctcaactgtctagagttagctgtacgaatctgttgttggctccagttataagaaccaagatatgtatgtaaggacaaacatccttaatttgcttagcaagtcgtatgtatttgatagaccaccaattttattttattttattttatttttgagatggagtcttgctctgtcacctgggctggagtgcagtggcgcgatctcggctcactgcaaactccatttagcaggttcaagtgattcttctgcctcagcctcccgagtagctgggattacaagtgctcaaaaccacccccggttaatgtttttttcttttcttttcttttcttttcttttcttttcttttcttttcttttcttttcttttctttttttagtagtagacacagggtttcactatgttggccaggctggtctcaaactcctgacctcgtgatctgcccacctcggcctcccaaagtgctgggattacgggattacaagcgtgagccactgcaccagccctgatttttaaaagggattttagaatttcagttgaacatgtgtttttgaagtaactccatattgaacaggggaatcagagtaagtaaaccactacaggaaaatcaggaaggcagactccaatttatgttttctgtgtataacctactttaataaagaattaaaaatcataagagtagttttatctagtggcctagaacttgattatgaaaagtaagacaaaggaaatctgacctcatgccagtgtctggaagccttacaggaactgaaaggacccacgtggaacagctggcaactgaaactcatcttgtcaatttcaagtgtagtccctcttcccaattcaccggagaaaacacagccagctttgcatacagtgtctggtgtcaccagagaaaacacagtcagctttgcatacaatatctggtgtcagaatgaccaaacgattggcttctatccttcaggattgtgaacagagagccaaggcatacaaccagtatgcccactccgtcagctgcgagacagaggagataaagaatgctgaacattatgggtcactgctttgaagtattcagaggccaaaatagttcaaaataattgtgttaatcattaaaagtagaagaagtggaagccaaaattatgcctgcctatatttcagttttgaatgtgtggagatcagaaatttaaaaaaaagtttatgagtttccccttttaaactttgagaaaagaccataagaaccggtgttttagtaaatcatcttcaagagtaatttactcataaaaagaaaagaactcatgataccgtgtaaacaaaaggctaataaatgctggtgtaaataagattaagggaggacaaagatgaaggaaagcaggacatatcaaaaaacaaatanaataagaaattttcagagcttgaatatacaaacaggcacatcaaaagaggttcaatggaaacctaatgcaatgaatgggacaattaatgcttttaaacatcacttggaaccacagaaaataccaacagaaaaatctggtcacgtacaagagataagagtcagggttccatggatgttcttcttagatgagaaggacacttcacttttatggcattgttcccacaaatccataacccaagtttcatcatgagcaagcctcagccaaagaaaaattgagatgtattttacaacatacccgttcaggccctttaaaaatgtcaaagttggccaggcaccatggcttccacctgtaatcccagcactttgggaggctgagatgggtggatcatttgaggtcaggagttcgagaccagcctggacaatatggggaaaccccaactgtactaaaaaaagataacaaaattagccaggtgtggtggtgtgggcctgtaatcccagctacttgagaggctgaggcaggagaatcgcttgaacccaggagccaggaggtggaggttgcagtgagccaagatcatgccactgtattccaacctgggcgacagagcaaaactccatctccccccaaaaaaagcaaagtcgtgaaaaacaaagtaagactaaggaactgtcagattagaggggactgaggaaacatgaaaattagatgaaatagggtatacagtttagaattatagaacagaaagcaggacatcagttgaacaactaaagaaatacaaataaagtctattttagttaatattgttgtaccaatactaatttcttagttgtaacaaataaaatatcattatgtaagatggcaacttcaggaaaagttgggggaaagatatacaggaatactttgtattatcttagaaactattatgtcaatattttaatataaaattattagaaattgtgtcagaaacactggatgttagaagacaatggaggaatgcctcaaaaaatctacagagaacttcttttcaatctatcatcatagcatcaatcaagtatgagcttcaaattatgatattttataatatgagaataattctgaaaatttaccttataccaatattttcttagaagattactttaggatgtgctatagtcaaacagaggaataaactaagaaaaagtatgatgtgagatacagaaaaatatatagaaacaatttagaaaaataataaaaagtagtcctatgataatagcaatataagaatgtttagattggaatagaagatgaatgccctcaagagtataacctctgaaagaaaaattaaataaataaaaaaattctgacaggatacctgatcagatagagatgtgacaaaccagtatgttgaaaggtgatgacagaaagagagaacggaaagagagaggcaggaaggaaaggggaaaaaaagaaagaaatgaaaggcgattctcacaccagttagaatggcaattattaaaaagtcaggaaacaacaggtgctagacaggatgtggagaaataggaacacttttacactattggtgggactgtaaactagttcaaccattgtggaagtcagtgtggcgattcctcagggatctagaactagaaataccatttgacccagtcatcccattactggctatatacccaaaggattataaatcatgcttctataaagacacatgcacacgtatgtttattgcggcactattcacaatagcaaagacttggaaccaacccaaatgtccaacaatgatagactgggttaagaaaatgtggcacatatacaccatggaatactatgcagccataaaaaatgatgagttcatgtcctttgtagggacatggatgaagctggaaaccatcattctcagcaaactatagcaaggacagaaaaccaaacaccacatgttctcactcataggtgggaattgaataatgggaacacctggacacaggaaggggaacatcacacaccagggcctgttgtggggtggggggaggggggagggatagcattaggagatatacctaatgctaaatgacgagttaatgggtgcagcacaccagcatggcacatgtatacatatgtaactaacctgtacgttgtgcccatgtaccctagaacttaaagtataatatatatattatatatatataaagaaattccaagaaaatcaaaaggctgcatacaaatgaaatactatatgaccattatttccttcttggctttttcaagaacaacatttacttagctaccacactgaaattactattcattaattttaagtaaactggcattgaaaatatggttaatctggtttttctttttttttttgagacagggtctcgctctgttacccaggctggagtgcagtgctgtgatcttagctcactgcaacctctgcctcccaggttccaacaatcctcccacctcagcttcccccagtagctgggattacagctgtgtgccaccatgaacagctaattttatatttttagtagagatggggttcgccctgttggccaggctggcctcgaactcctgacttcaagtgatctgcctgcctcagcctccccaagtgttgggattacaggtgtgagccaccgtgcccagcccagaaatgtgtttagtagtttgaaggggcaagtaccaggtgctaagagttcacaggggagggatactggacttagaccttcggaatcaagaaaagctttctatagaaagtactgcctaagctgaagactgaacactgaccaggctgaatgaaagatgtagtgctggagaggatttcagtcagaaaaaacatttgagaaggtccagaagaaaaataaaacaatttatttcaaggtactgaaataaattgagattaaggggagtgaagagtcaaggtctggagaggtattgagttgtcaagaaatacagtttgagaggtaaaggccatattaggaagtaatatatttttaaacttttgaagcttattctaaggctaataacaaagtggtgtaggcaggaaagttgcagttattataaaactttcagaaagatttatttaaattaattggaattgagaaagaaaggcattattttacgtaataaaaatatttatttgttgtgtaaaaaataaatagtttggcctagaggagaacagggccagtaaggaagaggagaaatgcatagatataaagggtgttaggataaagcataagtaagacttaatgataatttaaacttaaggaacaaggaaaatgaaggagtaatgaatacttgagtcactttgtagatagaggcaccaatcactcaactcagacagagtagactagaggtggttttggggaagctaaagactccacttttagatctctggaatatccaagatgggaattcaattaggctatgatttcaagttcaaacaagagaaacgggatggagatatttttagataccatctgataatgattagtgattgaagccatgggaatggatattttgtcaatgttcttttgagagctgtatccttccgtagttatctgatgggttttttaaatggcgtaaaataatcagtaatttagaagtttctataaagaaagttcggctacaaatacttatcctttctctttcattctcaaaccatgcattaaccacctattaatgtgtttagaaaaacagtaagtaattcagggttcatgctgacagagaagacccacataagcaaacctcgctataatacaaggagctaaattccccaatataagaatgcagtgtgctctgtgggaatatggagaaacaaagataaggaaaacctaggcagaaatagttcaattgattgttatttcatactgagacaaatttgccaagtataaactatatcctattacaaatttagatgctttgggccatgggtcagctccacggcgacacctacactgaagttgtatttaagctatctgtctggatcacttggttcacaaaaatgtttggattacaaaaaggaaatatcatacaccttggaagaactggctcattagtcaagatgctgcttaccagttgcctgggttggctgctgtggtaaagsaatatcggttggaaagccggggctggaagtcggggagaggctgtcttctatatcttacatttgctatgtctttggaggaaagatgctttcggcagtgttccttaaatttaaatatcttttccttttggactcaagggtatgtttattcgacttcatcatatctaatctcctagaatattattaacctgaagttattgtcagtatcgtatgatatttattgaataacaatatgctctgatactgcatatgaaatgaaataacaaatgaacctcccttactttaacttaactactaattaattagaaaagaaccttcactcaaggggtttggaaaggtccaataagggaattaacagatgagaatttaagagtacctgaacccatctcgatttgagatttacgtgatgctgggtgattagtgataagaacagaatgaagtcagctcaggaggcatcgtgatctggaaaggagggagatatttcagtgaataattgagaggattcagacaaagtcatatgagagaagcagagacagacagagggcaggagtcagtggatatgagaatgatactaggaagatgaagaatggactgatttgtaaagaaattgagacccaagttatactgtgttaagagataagttaaaaccattaaaaaatattgggagatcctgaattgctttcaagcctagtaatttgatgtaagaaatagtgagaaatgctcttgatgttgtgtctgtttcagggaaagttttgtggagacaatgaaataaataaaatagcatatttagatcaagaggctggttttctttttcacaggaaacatctaagaaactgttaaaagggacaaggtttgagtgttagaacgtgaaatagggctatggtaataaattgttaccattccgaagattatcaaattatctcccagccaaaaaaagagtttttaaacaaacatatgaagatatacaatataataaataaactagtatgtttatttcagattcaaccattttaaccacaaagaacaaaacaacctcaactgagagcaggcttgatttatgtaagcaaagatttggatttgaggcagtgaatataggaggcattggaaaagtttgggaaaaggctggtgggctttgtgagacaaagtgaccatgccatgagaattgtgaaaataatgtagatgtggaatcctgtaacaatggcaattagtgatgaagtggtgacatgggaataaagagaaatgggtcaacgtggatcatttttagaaggaaaagcactgaaactttggaatgagattatgaaaaaaagaggatgagaaattatgtttccaaggtttattgcaaaagctgtgatgatggcatacctcagatagaaatgaattattttaaaggaaaccagtttttagagaaagataatgaatccaattttgaacacattgaattcaaagtgacaatccgtcatccatgcagactaccatgtagacagataaccaaatagaatagaaacacccaccatatataataaaaccacaggtgcactcattgagtgaaccagtacagataaactatattgtaggggctctcacatctgggaataggaagactcaatgaaggcaataaggggaagttaaaaagaataagataaactggggaattcaagaagatcttctttggcttccataagatcctagactgtttctaggaagcagtcacagttcagccatggcccagaatggtgatgaccgagggcagggccatggtttggtgctcagagaccatttgccctctaggagcaactgatggagagaataaattggggagagaataaatctagggcagttgaaggagagagtaaattgtaaaccaagaatgccatagctaaaagggaagcagcaggcaagtttgcacttttgaggagaaattctaggaagggatttctccacatttccattttaggccagaagtctttgacatgctagagagaaagatggattttttttttaatgaataaatgagatagttggcatttttggcatttttggcaaagaaagatttcattttcaagaccaaaatttaaacagcaatatttagcacaaaaaatgcttgtcaaattcctgctgaatttgaaagcaacagcatattaaagctttttcttctttcctgcaatagctgatgttcacgatacagtattcccttgccctggtgggagtatgtcctcgcttatcctggtgggaatatgttcccctttatcctggtgggatatactccctcttatcctagtgggacatgttccaagactcccagtggatgcctggaaccatgaatggtaccaagccctacacacactatgttttcatcatatacatacacatgtatgataaagtttaatttataaattaggcatagttagagataaacaataatagctaataataaaatagaataattataacaatatactgtaataaaagttgtctgatgtggtctctctttctttcaaaatatcttattgtactgtactcacccttttttgatgatgtgagaagataccatgcctatgtgatgtgatgtgatgaagtaaggtgaatgagaaaggcatcatgacgcagggtggcctactattgacctaataagcaggttgtgtctgcagcatggagactctggaaaagggatgattcatgtcaagggaagaattgaatgggacagcacagattttatcacattactcagagcagtgcacaatttaaaacttatgaattgtttatttatagaattttccatttaatattttgaaaaggcagtgtgccacaggtaattgaaaccacagaaagtgaaactgcagatgagggaggactactgtattcttagagcaattgtatatcattggaatattattgatagtttaatgaaaaaacaaattagatcaacatgggntggtaccattaggaaagatggtagattttcaattcaaattcacaactttcaaagaaaaatattgtgagtctctgctatgagatagatattgagaaatggtgtagatatatattcgtctgttttcatggtgctaacaaagacacacccgagactgggcaatttacaaaagaaagaggtttaagagacgcacagttccacgtggctggggaggcctcacaatcatgatggaaggcaagaatgagcaaatcacgtcttacacggttggcagcgggcaaagagagagaacttgtgcagggaaactcctgtttgttaaaaccatcagatctgatgagacatagtcactaccataagaaaagcacaggaaagatccaccccatgattcagttacctcttaccaggttccttccacaacgtgtgggaattgtgggagttacagttcaagatgagatttgggtggggacacagccaaaccatatcaagatatcagcagaaatgagcaaaaaatgagtgattttaaaattactcggtttattactgacattctgatgtgcattccttaagagataattacattttacacctaatgccaaagttcttacagttcaaactctaggagcaagagctgcccaagaaccattgccaaaaagttacagggagagcctcagtgtttgtttggactctccagctcctaccttcccctctctctttccttgctcttctctctccatcattcttcccagccttcccaggttctggggactcagcttccatgatgctgcctcagactttctatccatacggtattattgcactgtgtctcagaggagaagagggaggccatctggagaaggtacagggcacctcagcagtgtctcttgcctgtccattgctcctgcttcctgatccctgccaggggcacacctggagaaacttagaaaacccttcagaaaagagtaacagagaaaactcaccaaatacaagccattcaatgtgccatcataggttcaacccaaatcttgtttcaggttacagatagagaattccagtgcttcttatcagctttacgaattttattcatgcttcagaaagttgctaaacagtgtaaatgaatatttgggagaagaataaaagaactactccgaaaatctgaaaagagttaaaataaattccagtgcactttgattcttcctttataaatacaaaggatttatggtcttttgcatcagccagggtggccactgggaagtcagagtttatctatatccatcttcacatttattacaaccacacacagcatttatcatacttgtattcagacatgatgctattattattttccactggcatggcttttaaaccccaaagcattagagacagatagatagatagatagacagagatatttatacaataaaagaattatatatataaataaaatttctttatataatgaagaaattcatataaaggaatatattatatactatatatggttgtataaaattatatattatacattatatattatatgtaatttacatgtttataatttataattatattatatataattatataatttataaaattatatataaaaattgtgtatattataaaatatgtaatatataatttataatatattataatttatatataatacataatatatattataatttatatataatacataatatataatatattataatttatatataatatataatgtattatatatatgatgtattgtatatatacatacatatttccaccaatgtgattttaaaagactaccataaactcactgaaaagaaaacataacagttggtttccaagacatgaggacatcagttggaataacgtttcttccatagaattaaatgcatctctggtgtcttggaaaggcaatttcctctcaaatgggtaaagtgtttgtactaatactgtataaaaatgaatacaataaaataggcgcaaagaatctcacaacttaaaacatcccatctttattctatagctgtaagctcagagagacaatgatcccatgattttatgggagtagaaaaacactttattgagtgttttctatgtatcagacactgtgtacattttgctatgttgtcccgattttattaaatgcagtccttttcctgttcagtgtcaccattcggaggtttttttcaagacactctggtgctccatgagatctaatctccattaatgtgacatatatgctgatattatgtaagtgtgtgtgcatacgtacactgacacacatcgtttgcatttgtaatttttttttacccagttgcctcataaaagattaaaatggaagattagactccattcagagtttgacaatgcctcaataataaatcagttctcatcatttgaagaactatgaggtggaacaaaaactgatttgagattcataccgttgtatacctactctttaaaaaaaagatgcaatttacacatctgcaaatcttaggaaatggcttagagaatttgcatgatttgggcacatgaagccattttagcacataaattccttcctttcatctctaacgggtgtagaaaggatacaaacatattttttgcagatgatgtgaattattgactggcataaatagcaactcacactaaatgcttcagaaatgtgttttttaattgagtgaagatggaataaaaaaatgcaggaaaagtcctgttctatgagagctgaagatatggaattagatacagtatttgtgagtgtgtgtgtatgtgtgtgccatagctaatattataatttttggttggtcttccttgtccatttaatgtttgcagcatttgttgatggatttttactaaatgatgacaaaataatgaagcagattagtaagaaaacctacaaattgtttactagatcttcactatctatattaaatagatgaactaaaaggtaaatatggatttttacctactaaagaaaactactagaatttattgcactttaaaaatatcatgtagtgtgttgtaaaatgaacccaatcagatgttctcttaaaggactatattagggtattgtaaatagttttcctaaaagtggattttttttttttgcaccacaattcaaataatgccagaattgccagctataaaccaaatgtgaagtccatgagcttgaaaagcccatagtgttcacggggatcagtccctttttttacactggaaacagccccagaaagttccagccagtaatgaaagatggtgcacaatggctgtgacagaaccgtgatcaaattcggtcattgtgagtcttctggccagcgtcgattttctaccacatgtgttttgcggcctccataagatgttaaaggaacactgaatcattggcaatccataatactcagattcttggcttagagagattatttaccccggggtgcctttctaacataaacactagccttgggtatagtaacagggagtacatagaatagtccaactcatatgaatgcaagaaattataatgtgattaatttttttggtcatttcaatttattgaaggtaattcagttggctctgtgaatgtatataggaaatttagaaatattaatatgtttttatttttttcctctaggttaactgaagtgaatcaaactattggattataattccatgaaggtaagaaagagctccagatggttttcatcctatcaccaggacctgcacagtatgagtacctggtgcataacaaactttattaattatcttttctctctttctttccccaaccatgtgtatacatacacacgcacacacacatatatatgtacatacacatatatacatgtgtatggatgcataatcacatacacacgtgtatatatacacatatatacatgtgtatgtacatactcacgtacacatatgtgtatatattcacatatatacatgtgtatgggcatatacatatatataatacatgtgtatgggcacattcctctatatacacacatacacacacgtacatacaataaataaatggttgaatggcaaaatgactaaatggatttagtacaacctaatgatatgccacagatttgtcaaagagccctggaattgagtaaaaatgaatgaactaaattccaagatcttttacaacctatgatttcattccagcagaaatttgtaaatatgtgtaccatagatttatacaaaacgttaatggtggcattatttggaatagctccaaatgggaaaaagcccaaatgtcaatcaacagtagaatggatggattttggtatatccatagaatggaattctagaccacagttaaaatgagtagattattgctacacccagcaacatggatgaaactcaaaactccttgagtggataaagccaggctgtttacgattacattctctgtaagaacttttattcaaatttcaaatacaagcaaaactattctacagtgagacaagtcagtggttacctttggcagttagtgtacccaggctggggcaggagggaagtttctaggtgatgaagatgttttaattcctgatctaatcctagctttactgatgggtttactttgaaaaattcatcaaggtgactatgcactttctgtaggtttacatgaaaatttcaatgacacacttgattgtatgactttggatattacttttcttttctgtgccttaatttcctcaattgaaaagtgaggaagagaatgcttacctctaaggattgacatcaagattagtggctgagcacggtggttcacacctgtaatcccagcattttgggaggcagaggcaggcagatcacaagatcaggagtttgaaaccagcctgggcaagatggtgaaaccccgtctctactaaaaaaatacaaaaaaaaaaaaaattagccaggcatggtggcatgcgcctgtattcccagctacttgggaggctgagtcatgagaattgcttgaacccgggaggcagaggttgcagtgagctgagatcacgccactacactccagcctgagcaacagagcaagactccatctaaaaaaaacaaaacaaaacaaaaacaaacaaacaaacgaaaagattagattagcaagtagagtatgtgtaaaaccacctggaaaaatgcctggagtgtgtgttcagtatttaattgtagaaacagttaccttcataaacaacaggacattgtgggaacatctgttaattaccgaacagtctttttaggaccccctggggtttgtggatagtaatttttattaataacacctttatatgggctgaaatcacaatgatactgtgtcaaattaaccagcagttaagagctatgcttcttctttttgccaatttacttgttttatttgtttttaattgacaaataaaattgtgtgtatttatcttgcacaacaaggtgttttaaaatatgtatacattgtggaatggctaaattgagttaattaacatatgcattacctcacacagttattttaggaactacgtttccagaagtctgtaaggtagatggattgatatttttaacctgattcattcattcttcatttaacccaggaattttttgagggtcagtttcagagcatgcgctacactaagtgtcgggattactaacatcaaggaacagttactgacacaacaaatcgatgtgaagtcctaaaagagagaacatagacagacacataaaaacatagtataacacaatatattaaaatatacacaacaaaacatataagataaacacagaaatgtttggagcaatgaattagatacttaactggtttagaaatgttttgaagaaatgtatgctaatatgtcttttgttcaaaatttattaattatataattaacttttaattatgataaaatacataatataaaatttattatcttaagtacttttaagtattcagttcagtcatgttcactatatttatattgatgtggaacagatctctaaaacatttttatcttgcaaaactgagactctacaccctttgaacaaccttccattaatattgtttacatgttaacacatttcattatattataatgtattatcgataacatattatatataaatatatttataaatatacatgaaatttgtatatttgaagtattagtttcaaacaatgctacatatatctaaggcttctagtcctatattggacttacagtggaaatctgggaaattggccagcatttcagtgtgaaggaggaaggatgccgtgttctctcccatctgtttcagaaaaccagtgtggagaagatgcataataggcttgacgcattttttataatgatgtttatattttcattttctttttcatagtcacaatgaaagtgaaagcaaaggaaagagctaatgtcccacaggccactgggtaatagcgaactgtgaagggtgtggagtggactcactgggagacgggagcccatggacccctccccagctcctttgctcccacagcaatcttctcccttctctttctttgtctcacagtctagaagagtgacatttcaaaaattatagcagcagaggtgtttttacctatagcaaaagatgtacatgtaatcacattatgacatactacaaaacaggtaaaaacagtagtttttagtacttttataaattcaaacttagcaattttccttatttcaacattaatatcaataggcattaatgccagttttttaatgccagtgatttttaacctgctgaaatttgttttataacttactgcggggtaaatgagatatttagttatacttttgaaagtattgcttgtgtataaaacaccttgaaataaaagtttgaagatgtcctatgagttgctgtgaaaagagtagttgtgaaagtttcaaaatgacagatgcattttaatggcagagtaggagttcatttatccaaaaaagagggaaatacagctcaaagagtaaagcagatgcagagaacagcaaacaacggtcagagcattgtgaatcttcggctttgatcttgagtacctagctagatattactgtcaacggctaagattaaaatgtaacaatatcaggggaaatgcatttgagaacagtaaaacatttattttgtacatatatagcttgaaatgcatatgggaaatgtaggtggagatttttagtaggcaatagcatatgtgagtttgaaatgtaatgcggatatataatctaaaactggttctcaattctgactgcacattaggaaatttactgcttaaaatgactaaatctcaggcccaactgcagattgattaaattaaaatttatggggatgtgcgcctgaattttttttttcattaaaaaaaaaaaaaaaagactccccaggcgattataagaaactgccagctttggaaactgctggcctacaattagtgtcaacgtcatcattgtgtgggctgttgttggatggatgagaacaaggatggatgagaacatctagagagtgcaggttgttcctcttcttgtcttctatttgcccttcagatctgccctttcatgtagtctgggcaccagagcaccctgagcccagtggactgcaccagtggactcttccatcctcagggttttggtaagcaccatctagaggaggcatagagagaaaatcagggacccaggaaggtgaaaacaggttttgttttcccagcttcctttctgctgggtcaaggggtaactgcaggttgagggtcatcctcagtcaaaggccacagctgcagcaggtgcacctcttcacacagctgcttctagagtctgcttagctgcttcaggtcaagggatgatgaggtctcccaactgttgctagctctatagttctcagccatcttcagttgattcccctaaatcctgcctgccccttcgtagacagtaccttcattaaatattcctcattggttaaaaagtagtgaccttgtgctgaatattctatgccaagcctctgcctgctgcagtaacataagaagagttgtggctgaagatggaaccaagagagaaaatgacctttaaaagatgtaacgaggtgcccagggaaagttttggcaatggaatctgagcatgtagagtttaaatgtaagaacggaaaaatatctgttgtatttgaaaggtcacgaaaggcttcttcccgagaggaattttagtggtgcgctaacaaaaatcagatggcaggggctggggcatcaatgcaagtgaagaaatgaagggtggttatttgacaagtttgatgataggaggaataaagaatttggatttattaaaaataagacatggagctaatcaattgagattgccaaactcttttaatgaaaagtagctgtgctctatctccagcagttgcaacagagcactaataatatcaccgagactattgatgtgagggcaatatacatactcagtgctgtaaaggcttagatttttgatagctactcaaggaagaacacaaagaattaagtcttgatttttaaaatgaacaaagatataaagagagaaaatacagaatgtatacgaataatcaaaacatatgaaacgacagccatctctggtaatcaaaagaaggctactacaagcaatgatatatgttttgccttataacttcataaagattcagaaaatgggccatagccactattggcaagaaggcaaataaagtccatttttggtcagaatgtcaatttatgtatcttttctgaagtctggtctttgcactcttacccttttaaagaaaacattaattgtttcactgaagctctgagttcatatggccatgctctcctgcccaggtgttctctcccttaagccttctcttgagcacttatgtgccactcatcatcatgacttcagtccttaaagtttctttaataccactggactataaaataggactgacgaaaagacccattcaacattccattgaaggattaaatgctatgttttaagatataattttataacatacatctatcatgaaatccattgactcttcacaattagatgctcttacatagaaaacatagttacttacaaagtcatggttgaaatgaatctctgctgtaacgccattacatatccctaaaacatatttaagaattatgaagaggagcattattgaaaacaaaatgtattgacactaaagagtaactattttaaaaaggtaatatcatgatactcatatgaatatcaaatgaatgcatgtcaaatattttatttaactctttaactaatgaagaaatgggtatgatgctacacccaattcaaggtagaattcaaaattcaaaataaacacatatatacataaatcaggaattttgaaatgaatgtacaaaatgatgcaaaactggctttttccatggagattggggtcgttgtccaggaatcagtagttatttccagggacaaaattcatttgcatttctatgggcaagtgtcatttaaactgcaatcagttatctacaatttatggaatcgtaaccactttaaaaaagatgaaaacagttaacctgaaagtttctcctgcactaaatgagaaagaagctcagttatttttaaatttgcttatttttgtcttgttcttttttaatttcacaatatttgactgacagtaacttacctgatagtgataaatcaatttgtgccacatctcatggcatatcagctttctgtgtctttgtccatctcaaacaaccccacatgcctacctcaacatgagttttatctcccttcaaactggattaatggtatccatgttacatgactttatacgtgttcttcactttacagcaaatagttatgaacaattaatggaacacacacacacacccagataggaatgggaccctctgagttttgttcacagagtctatactcttttctattgtgtcatataatggtgacaattcaattaggtggcctatgtccacaatccatggcataaacgccggtaaatttacagattctccgcatcctatttggcaagtgcttcagtgatatctgtagcctgaagagaaaagctaagtttttcctatttctctctcttctttccttcccttttcttttgaatttcctaaaacaaaggaagaaaaaggaggggaagaatttggcaatgtgtcagttaatttcatcaatgtagacaaagttaaattaggaggctgaattaccaagactggctgtttccattgatgaaattaaatcaggtaaattgccagtgcttcacaaatgctgtctcaggtgtgactgaagttgtgattgattggaaagtactcacagagaaaacaagtacaggaaaaacagcactattccaaaatgcagaacaaaaccacacatatttaggctttacagttttcgtgctccttcatattcttactttgatgtatttctgccttttaatttagscttttcctaaaaaaaatagtttgctttacagtttacaaagtaagatatgctttaagaggtagaaaaatgaggcaagtgaaaatgaattaaaaaaaaaaaaagaatccaggagcaaagtcagtccacaaagtttgtctgtgacatcattgtccttccaaacaaggagcttcgagttcaactccaaacattagcagtgcagacgggaaaatgcagtgaccaaaatcagagtccctgggtgaaaagcaagccatttaataggaatgaaagagtcctgctataaatactacagaaaataattttcaaatctactatcctaaggagaacactgtgcaagataatgaatatcatctttagaaacatcttcttgtaattatttcttaaaatatccttccagacaaagcaatgacatcattacaaactccaacttagcaaaacgctttttggaaaaaggaaagtggaaggacattgagtgatgtccacatatgtagctctctgatgatttgacttcatccaagaatcgtgtggaaacagctagaatggggtgaattttatatctcccaaacagtttttcataaatatcattttatttgactaagctttcaagtgtgactcaatgatagtaaaggggagaacctaattcctgacaattgcatgagatgttggtcttcagtgttgccagttaactgagaaactatgttaataatcagccgcgttagcccttttctgttagataattttattattcgcaattctctttgatgggtattaggtttagacaattgaccagcaaactatttttttttgaaaatgaccacaaacatgttaaaaatggatgaaccctgagaggagacaggaaaacagcacctaaaaatagtagaaggatattatttctctgccattatggacttataacataataaacatttagttggttcacttttttagtatcaacacttttattaattgcttctttttttacaaatttgattttattattttgatacctactgatctctaatttcttgagaaagtctgtcttactttaataaaatgacatacagtgcattttaaacttaaatactgtatattcatatttaaatctgagattattgggacataatgatataagaatttatataaggccatcctctgaatccatattcaattaaactaaaaaaggatgtccgatttaggaatcccacagacccatcagtaatcaggcaagtacttaacagccatcctatcattggtctctctagtttttatttattcttgtagtattagcagatgatttctataatgttgatcaaatcagatttacgatctaagttgagttaaatctcagagaatcaaactccattgtggaatggaagtttttagtttcttatatatggcaatattttgtaagatattttcataactaacaaagtattctcattataaattaagtacatttctcccttaagctttttaaaaaaaatgattttagaaaattcctgaaataagtatcaaaatgcaagattgtaaaatacgttttgataaatcagaaacattcttattaagagttttctttattgataagttatacttctatgtttataaaatatgttgtattgttaaatgaagccaatgaaattgatcaagggttaggttttagaatatttctgtccagagctttgctcctccaaattctgtcgtgttagaattttattttttgactacaggaggatagaagcctaaaacattttaaaactacataatccgtttttaaaattacacatgtaaaatggtgtgcacaaataaatactctgtcacacaaacatgcacacagagcataaacacatgtacacacattacatattaatgcttcttctaggacagagattaataagtagtagagaaaaaagaattacagatacaatctcaaagcttgtcatatttctacaaggtaaatatatatctcagtgatagtgctatcaaaaccataccatcaggttaaagaagtgggtaaatattatcagaatttaatgtgaaaacaggattatattcctactattgcctggtgacatagtactcaacacattttttttcgtgttattcatgttaaatgttaatctgttaatttaaattaaatcaaattaaataaaatctgttaaagaaaattgttcaaatagcttctccctaaagttttctttagttcaaaagattctgatgctatattttaacctacagcttacaaacaaatttgggtcttttaaaacttccattccctcaattttagtaaaaaagaaccctacttttataacttacattaaacattggaaataatgtataacttacttattagtcttaactttgggagagaagaggtttaagtacgtattttaaaaaaaacaacagaaatgagtactcatgataaatagtatatgcacctaaaatatactaaaattaatgagtacaaatactcattcagctctcaaagtaactctcccaactgaataaacacgtttaaaaatattttaatgtatttatttgtgagttacacaaatccattagtttaatatttagataatatgacaatgatatatgagacacaatttattttaagaatatttatataataaataaataaataaataaataaaaataacataacctaagtataccttagaaaaactatggggaaatgttaaagataaggcttgggaactttgccagcacagtgtgggtatcatagtgtaggtattcttatttcaattaaactagttgctttcagtttaaaaagtagatgattttacatacaagtttgcacttctagcttctcttttcaaaatgagttcaggccttcccatcctgacaccttgaaaaagctgtggcgaggccgggcgcggtggctcacgtctgtaatcccagcactttgggaggctgaggcgggcggctcacgaggtcaggagatcgagatcatcctggctaacatggtgaaaccccgtctctactaaaaatacgaaaaattagccgggcgcggtggcgggcacctgtggtcccagctactccggaggctgaggcaggagaatggcgtgaacccgggaggcggagcttgcagtgagcccagatggcgccactgccctccagcctggggaacagagagagactccgtctcaaaaaaaaccaaaaaaacaaaaaaaaaaacaaaagctgcagcgaggccgtttctgaagatggcgggtattgggcactctttacttccttgactctactcctgcactctgagactgaccgtataacatttccgattttctttgatttgtgctattgtttttcttatagttaagggaaatgtgaaatattattgtacctttgtctgtcaaaatttagaaaaatgaaaaatagaccaaaggtgggagtataattcattgcaaaaacttgatatcctaagctagtgtgtcaaaagtgtacaatttcgagcattattatgaaataaatttagtaagatctatcaccaatatataagaaataggatacaaagttttatgaactaaaaagaaaattctcattgaattgttttttaatcaaattaaatgaagctacatcgaaatatttaaaaacatgttggcaatgatgagtctataaagcaatttagtgggtataaccctcccaatttgctgatatgggccctgcctggttttgggggccttgaatctgcaatccctggtggaggacaacacccctgtttctccggacctgagagtttttcttttaatctaatttccttcacattttaatcattagcttatcttcaaacttttttaagaatgatcttaacaaattaaaagtactttacaatgtattgcatttactatgtttgaataaaacattattttgccactatcccaaaggattgttatatttttctattttagtaagtttattgaagacaaacaggccttgggccgctgcctctgtctctcctgccttccccactgaatctccagcccacattcacaaacaaagacaaacctgtgtaaactgaagcaccacaaaactacttttatgaaagcagaatggaaggtaagtgtcataatctgttcccccttgtactgtagcataaactttatcgaactcactgcagcaaatacctttgtctttcaccaagaaatggaaattgtttggtgtaattgtgccttaccttcccgaggtatatttctggatttgatttactgaattcaaagttgaatgattcaccaaacttcttggttttcaatgcttaaagtcccaaataacttttcttaaaatcagagctgccaaagttaggaatgattttaatatcaattcccgagaggtgtagaagtagctactgtgctatttctcacactttatcaaccaaagtcaccttcacaagcatcctcaggatgaagacttcaataactcttaggctgtccatttctctaatgcacatttgtggttgtcagaaaattttttttatattgatttgaatcaattgatccatgttttgcccaccagaacaacagaaaccaaatgtattctttttgtagtacttttcatttttaaaaacaattactagaatcccctgagtcttcttttgttctgtggtccttcccccaggacagtgtgtccaggtggactgcccttccaaccctctcctctctttcagacaactttgtccatgtccctttgcagaggccctgggcagagattcccgccgggaggtctgctcagaccagtgcacgctgaagctaatgagtcattttatatggacttggtgatgatctcagtgtcataaaaaggagattccattatttctctttcaaatacagccctagctgctgaggcagatctctctgattctgtattttaaattgatttttgaatttaaattgagagatttcaggtcttatacttttagagccaaaagagaacgttcacatcaactggagattagggttaatgttccagatcaacggccaaatagttacgtgggcttgaacaactgtcccagttggcctcctgggacagctgtttgctgtaatatgggaataggaatgtcatctccccctgccttacaggactcttgtgaggatctactaaagaatacccataaaagtcttttaaaaaggttagagaacagaagatgtcattggtttatacgtgtatcctgattccactccttccatatcattgtctcttcgtgaaaaccagacttctctaaaagctcttgtattattattttttttttttccaaacaccaaccaatactctgacaccatctgtgtggacagcagttcaattggattctaactaaccagagttagagaaaaccccacgggatgagggcccaatgccacaagattgcccccatatcacatgccagccacaaaaagagtgccagccttcctggtctcctgccaggcccactacaaacacagggttcccaccattcccacccctccaaatgtgacaactttttagaacaactcatagaactcaggagaacactacacttactgattttttnnggtttnnattatgaaggacagttcaggaccagtncaaatggaagtggtgcacaggacgggctgggtatggggtaggggaatgactgggagcgtcctcaccctctctgggggcaccaccctcccagcacatccatgtgtttngccagcttggaagctccttgaatctcttttngctcacgagtttttataacccaatctctaataccctcctttccctggaggttagggggtatagctgaagatttccaacgcctaatcaccatttggtctttgttgtgaccagccctatcctgaagctatacagagggccgcaccctaggttacctcagtggcataaacacaggtgtagtagaaaggggcttattatgaataacagaaggcactcccatttctgctagtcccgagggttttggtagttctgtgccaagaacaggggaaaaagatgaagtacaatttttattacaccactgctgtccatactggttaccagcattttctttggtctctcctcaaatgacaccactctccgctgccctgtcacttccctgaacagttctcttggtgattttctctcctcgtcctactttccctttcatgagcacaagaagtagtcaagcggtgaaccctttatcgttcttgaagcacctctcactttggagactttaataccacaacctgcttgttttccttccatgcttctgactcttcctgctttgtctccttggagatatattagtgagagaagtaaaatgttgcaactggtttaaatgataatttgatatacagatatatgcattctccaaggcacagaatgtatttatattgctaagaaatgtgctaaaaagtggagacaaggcctgaagaatccctgagcagacaacactagtcaggcctcataagtgacctcaaccttgtttgatttgcaaacataagtgaatgtcagcttgagctatttcttgtaaatgcctgtattcaaaacagaacttaagcttaaccagtcagaagcagtctactcacttataatcctataactggggggactttccgaaggnatagatcaaataaggcaactgtataactgaaaccaaccaaatgctttctctgatttacttctgtgttgttctataaaagcctcctctttctgtttcctcagtaaagctcctgaaccagttctactttggaggtgcccaattcatgaattgcttgctcaaataaactattcttttaaaatttattgggcctccatttactttcagataacagtaattatttgcatgcctatggaaggaaacattggtattactgtcttttttttttttttttttacaatttaagttctaactctacagaattgtaaaataacataagaattaacccaaaatgtgcattcctatcaagtcagataatcacccagaaatcctgctaaaataatttccagaatttcactgaaaggacacctagtcatttcttttgcccatttcctgacagtatctccactagtaataaaaataatattgaaagaaaattcttaatctcaaacaggccaaggatgcccataaggtttgacctgatatttacatagttgcagaagaatttaaactaaccatatgggcatctttgagtttattctgtagttcttaatcaatgaattattaagcaactactaagaccagagaataaacttatgactaggagttttcaaaagaaatctttgattggtcttctaaaaatccctatgattttcttttctgtattagttcattttcacactgctataaagaactacctgagactgagtaatttatgaagaatagaggtttaattgactcacagttctgcaggcttaacaggaagcatgacttaggggtctcaggaaacttacaatcatgccagaaggctaaggggaagcaagcacatcttaccatggcagagcaggagacagagcgagtgaacaaagggggaagtgccacacattttcaaaccaccagatctcttgagaactcactcactatcacaagaataacaagggagaagtctgcctccatgattcaatcacctcccaccaggcccctttcccgacacatggggattacagttcgagatgagatttgggtggggacacagagccaaaccataacatattctaagacgaggaaactgaccacaagaaactttctccagcagatttcacctgcatttcctacattcaactgaatcctttaaattgactgaggcacatcctgtaccaaggagagacctttgttactgcctttgatcctgagaccttctgagccaggtacttgggtgcttttcctggggaggctttgaggcgtttactccacacataatgtcaaacgtgttttataatagtgggatagtcagacttgattaaatgagaattattttcaaatatgatactaagtaaggtcttgagtgtagaatcaaattgtccaattatatcctaataaaaaggaagacagattcttagtggaccttttcaactatctatacagcagtttcataaaacattaggaaatttagtaaaccttattacttctggggagtcagtgagaatcagatacatttcttaaatgtttcatttcatcaagagcagagtctatgaaattaagggtaagatttgcttcaaatcttaagaagaaagcactttgatatatatcttttaaaactaaaaacaacattgatggtattctacaatacttgcattttcctctcacttatgtagttcattcctgttctcaggaaccctgcttttaagaggaaggtcttggccaggctcagtggctcacacctgtaatcccagcactttgggaggccgaggcgggcagatcacctgaggtcaggagttcaagaccagcctgaccaatatggtgaaaccccatctctactaaaaatacaaaaattagccaggcatggtggcaggtgcctgtagtcccagctactcgggaggctgagacaggagaattgcttgaacctgggaggcggaggttgcagtgagccaagatcacaccactgcactccagcctgggcaacagagtgagactccatctcaaattaagtaagtaaataaataaataaataaataaataaataaatacagtgtcctggaaagcctgactcggtagatggttaccctctgagagttggttaagtaatatcaccttagcaggtgatattacataagagaccattctggaagtataaaaagttaaagttgctggtacaaacatttccacaaggctctaagagccctcttttactgaagacaaactgtggtgtgaatcttacatcagtatccaacatcagagtaacgagaaactacctgtagatgacaaagactgaatggctgtggccaatttattataataaccagtgatgtcagaatggagaagaggggaattctctatggggtgtagtaggcaacaattccataagagtttggcaatgtttctcctgtgctgggaattatcatgtacagccagagtactggcaaatcttctggaccttcccatgaattatataatttctaaaatatttatattaataatttatattaataaatgaaattgtgtccttgaagttcatacatcaaattcctaaccacgaataggactctatttggagataagggctttgtggaggtaatgaagtttgaatgagatcgtaagggcagggtactgtgatcataagaaccccaatatgactggtgtccttataagaagagggagagacacaaggagcatgcttacaagaaaaggcaatgtgaggacatagtgagaaggtggccatctgcaaatcaaggagagagaccttacaagaaacctaccttgccagcaccgtggtcttggatttccagcccctagaactgtgagaaaataggtttatgttgttcaagccacccagacagtgttattttattatggcagccaaagagactaatacaataatatttttctgtttaaattttatctagcaatagctgaggatctttcccaatttaataatgcttgctatgcagctctcaccatagtgtcgaggtaatttaagaaatatagtgcacatcacaaaacataattatttgtagcatcactcttttcttaaggtgaaagaataaatttttatgaaatctcaaaagagatgtagacatttgattcatttttcttaatttaggatacaatcttagaaagccaaaatctaaataattgttggtggagatttgggcacttatttaggataagatcatggatacctaaaaaacagtggttggttaattcatcaaaatgacatcaaaatattttaaagtaaacttagaagtttccacaattataaatattcttagctctttccaaagctagaaaatgttttatttttagtaatcaaagatatatgaaagtaaacacagaaaaattattcaagtgggatacagaatctctatcacctattatcagaattttgattacacaaaagattaaaaaatgacttttcacattgtaggcaagtcacgcatcattaaaccaagggaacaagcacatcaaaaacagagtgaaatttgccaaaatataaaatattttagttttgttttagattaatatgttattaacaaagacaaaattcaatttctaagttttgtttttcactatactctttcatattctggaaagatctgtcacttttctaaaatacaaaactaattcttttcctcgaaagacaaaaatatacacacttgtgtttccctgactctattatccttagtagagtctcaatcacccatttgattaagcttatttcatagaaaaaactgggttaatgggggaataattaagaacggatgtcatacagtatttactgtattaccaaaggtcacaggaaacacacctggtggccgtgtcatccatcctttacatctgcttgccatggcaaaaataaatatactcattgatatagatgtatcccaagagatagtcttctggacagcatataaaaataacaagcacaagtatgtaaacttaaatttatatttagtagtcaaggactcaactgttatacattcattagaagttactttgttttctaagaattctccaattttaagggtatttaacattagtcaaggtcttaagtaacctaaggaagttagaaactaagttaaagctgtcacactgcaacacatagttactattgacagaaaaggtttatcataataataatttaatttaatgcaatttttcatattttacacattgtgcagaaataatgttagtttttatgatcgatagaccactataaattcagaaattgcagtttgactcttatcatcatgagaaaagcaaccaaaatagagtgaattgtaggtcaaattatatttagtgtggctttatcagaaaaaacatatagactttttaataaatgaaattatttatataatttgcctaataatggaattagataaacttggaatttaaaaatgcttctgaactaaaggttttataagaacatttttaatgttttccaactttattggtttataattaacataaaaaatgtatatgttgggttgatgcaaaacagcaattacttttacacaaaccaaatatttaatgtacaacttgatgttgtgacatacatatacactgtgacgtgacaatcacaaacaacttagtgtatgtatctattacataccatggttatctttgtgtgtttgtggtgaaaactcttaatatctatccacttagcaaattttaagtatacaatacactattaaagatgatatttttaatctagtgtatttaaagtattagtttatttttcttttttttgaatttggaaaaattggatttatatgtacatttatctttaaaagccaattagaatagtacctctttaattaaagagataggaacatttatatccactaactgaggtcaagacctttcacaattacagagtcacaaacgtgttagagaactcacagcctgatatcttccacttcagccacgagtcaagaatacacacaaagatgcaaaaatccaatggctgagatctcaaagagaagttcagtttcccaatgtgcataaaattctcaattgatttgagctcacaagtaaaacaaaatagacaataagaataataagccgattacgtcatcttttattcaacagacagtagacctacagagatcatcgaattggcagatcataaagccaaattcctaattgcttcctccagtggaaaataagccatcagctatgtcttactcagcaacaaaacaaaatatatagttagtaggaaacaaagttaaagaaacagagtgaacaaggttaaatatctattgccatttgataccctctctgggaggcaggaaaattgttcatgggcttaagcaattcaggaggtccatttcttcagccccacagtttacctgactctaagttgatgaactagacattttggcagataatctacctctaaacccattaacacataacattcccacaggtaaaatcacaattctcatggaaatatcaaataaacatatgtcaaatgttatttaactcatcagtttaacgaaagaaccagtaagatgttgaaatcagttctcagaaatttgttggtttttttttcaaccaagaactccccactgacaccaaccctatcaaaaattgccatttgacatttcatctggatgttttaaaggcctctcaattcactgtgtccaaaaaggaattcatgactttcttttccaaatctctttccttctcttggggtgttcactacttctggcaatgatcccactttgtgttgaattatttacaccagaaatctaagactaataaatgatactttatctcactacactttcacctgccattacatgtttattaccaaactctgttgattttactttctaaatatctcttacctgtatctgcttctaacttaaccacgttcatccataccatgacaccaccatcaccatttcatctggaccatatcacttagactaaaccattagccatatgtttttctcattggtttcactacctcaagcatcttcttatccctccagttttgtccatatatcagccagagtgatagatatgataatgtattctactattagaaatccgtaatgatttcctattgctcttgggataaaaaacaaaacactatgaagccccattgatcttaggatagggacttaaactttcttattctccaccatttttgtgatagagactcaaacactgtgatcctccctcctcttataataaagacccaaaccttataacacttcatctctcttaggataaagaccaaaatctatgataccctgctgctctcaggatagagacccaagccctctatctggagtacaaggctctcttacaatgctgctagttaccctaacttcctctcttcaatattgtcatgaaccaggattcccctcactttctggctcagccttccttaatttcttcataggtttctcaacttctcatcactgcatcttagaagtgtataatttatttatttatttatttttactttcaatatttttctcttaaatctcctactttgctgcctggttcaaacctatgattatccaagtttatctcatttttattttgtcagggccttttccttgactgttcaggcaagaccaagttatacccctctcctgatagcacttaaaaaacattgtaatcttggccaggtgtggtggctcacgcctgtaatcccagcactttgggagaccgaggcaggtgtatcacgaggtcaggagttccagaccagcctggccaatgtggtgaaaccccgcctttactaaaactatgaaaattagccaggcacggtggctcatgcctgtaatcctagctactcgggtggctgagacagaagaattgcttgaatctgggaggcagaggttgcagtgagttgagctgagatcacatcattgcactccagcctgggcgacagagcgtgactccgtctcaaaaaaaaaaaaaaaaaaattgtaatcttacattgaattttgtggttcagtttttttctctaccactgcacagttaatttcaagagggcagggccatgtctaattctacttattatattcctactgaatattatgtagttgacatatattaaataattttaatttaaataaaatgtatttattgagtgaatgtaggacttgctgtcatataacatatttctaagtctgattctatcttctactatactagataattagttccaaattttatgtatatacgttataatgtgattagactcccataaaaaagtattaaataataaagagagttaatgtgtcatatcacaagaaggccagaagtaggaaagttgtagtagtttagcctctgaatcagatggggttataaattaacttcttttactcaccagctgtgtgagcacagttatatatttacagatcactgaaacatttttttgaaattcagtctgctcaagaaaaaaaacaggaatgagaatattacctttcacacagggattctttcaaaattactgaattaatgcattcaaagaattctttcagtactgttcaagcacttcaatattaccaatgacagtttcctgcagtatcttggatattattcacgtggacctatagagtgttagccatttaaaagtcatcagctgcttttgctgtctccatgtttattgcagcatttaggactaggttcaactactcataacagaaaatgttactgtagtggcttaaacacaaataatttatcttgtgcaaaacattcaggggtgagcatttggggagaataacaccaagaagccagaccctttgtaacttcctgcagtggttttagcaccttcaggcgggaaagtcaaagaagagaggagtgacattgggagactttgatgtacgtatcactgcccagaagcaatcatttctaacagtgaaaaaggaggggaaatgaaggtttttgcctccacaatctctatagtagaagcagacaaggcaataggggaagggaaaaaagtttggtccatcatatatcctaggtgtaggtatttgagggtgatgaccataccagttaattagggggagatgagtagatcctcatctcttccaagtataggaagctaactttgccgtaattgttactaatacacccttcaaaatcaccattttgaaaggttttgtgaaatgagcattattttcttttaatacaaggtcagaccttcagaatgatgaataaactcatttgagggcaagtaccaattcagagctgctgtaaagtaggcattttcaagaagaaggaatacttctcatgtttgaactgtgtaagcaagtctttatttattttttgaatcctgaaacagcaattagaaaagagagaggaagatatttccttttctgaaggctgccaagaataaatcctattctcatttgttaaaataaaaagaggtaataagctaaagtaagaatacactaaccttattcttgaacccagccgcctctagaaaaaaacactataaaagtgaagctaagttcagtaatttttgcagtcattgcctttttgttagctctagttatctttcaagttttattgataataaaacattaattgcaaggacaacttttgaaatctattattgaatacctaggacactcatgatgtctctccacattcttgccaaggaattgctttatgaattaaaccacttggggaattaaaccactatcaattaaacatacagttgtataaggatagacatatactactttacatgcaaaaatttaggccatagcaatttagtaactaccacgttacagggactggaacttttcactcctccacttcttctatctcaccactctgttatatgaagctatgattctccattcagaatataactacattagtttttgaaataggaaaatatgaaggacagactctagaaatatcagaatcacttggacaacaaagtccaaaatatgtattatgaaagtgaattatcatgtttgactcaatatgttgctgcaaataaataaaaattatttgctcaatatagatactccttatatgcctcaatattttatatacactgactgaatatttatgactatgtatgagcagaataatgagaaaaaaacttactaaaaaatctaattattttgttccttttcttaataaatgtcccgtttcacagttataacactttctggatttttatttttattctgactttataaaataaacattatttttagaatagttttaaattaacaaaaaaacacacagagattacagaatgctccatatatgttatacatatatatatatattatatatacacacacacacatatatttaaatacgtatattatatatatattttatatatcccgtcccctcccctagaaatcactgaattgtttactggctctaaagttttgctctcattattaaatatgtaacaaatatatattatatatttatatacaatgtatataaaataaatatatatacacatgtaaaaaaatatatatatattttgcctgctccagaattccattccatccaggataccacagaactttcactaatcttgtctctttgggtgcttcttggctataacagtttcttaggattttcttatttttgatgaccttcacagttttgaggagtgctggtcagatattttgtaaaatgttcctttcttgtaatttttctgattttttaccatgattagactggacttagggcttgtggggatggactgtcacagaggtaaaatacattctcatcacagcatatcaagggtttatactattgacatgacttaaaactattgatgttaacactgatcacctggttgaggtagtatttgtcaggattctccactgtaaagttaattttttccctgtttctatattgtattttagctatatcaataagaactcatggacatttctcttgtactttgggttataatccaatcttttttatttttgctcaaattgttccagctttggtcatcggacactttaagtagctgctgtgtgcttttgatgttattgcagcttggtctgtttagcactttcttactttctaaaatgtcaagatgctccaggcttatcttgtatattaccttatgtagctccaggattaaccatttctccaaggttttgacaaactcatagtgtcatgtattcaccattacagtatcatacagaataattttacagcccgagaacagccctgtgattcacccagtcaacctttccctcccttagaaattactgattgcttactggctctaaagttttgctctttacagaatatcacataaatgaactcatgggtatgtagcttttacagactgacttccttcatttagtaatatggatttaagattcatccatgtctttgtgtatgttgatagcccatttttaaatcactgaataatatttcatcacatggatataccatggtttatttgttcattcacctattgaaaggcatcttgattgtttccaatttgggacaattataaataaagttgccacatgtataaatatgcatgctgctttttgtgtggatataaatgttcaaataagttagttaaacacctggtagtctgattgctggattatatgataatgctacatttttccttgttaagaaactgacaaattgtcttctaaagcagttgtgccattttgagttctgatcagcagtggatgaaagttcccattactccatttcattgtcaacaattattttcattatgttgttttctttttggtgagttttaaaatggctttgtatattttatatataagtaatttattagatatgtgttttgcaaatatctccttttagtctgtggattgtctttttattctttgaacaatttattttataaaacataagtttttaattttgataaagtccaacacatctatttgtttaattgattgtgctattggtgttatgtttaaaaactcatcaccaaatcctgggtcagacagattttctattatgtttttgtctagaaatttcatcatttgtattttacatacatttgtgatccattttgatttaattttgtgtaaggtataaggtctttttctaagtttatttatttatttatttttgtatgtggatgttcaattaatccagaatcatttgttgaaaaaactattctctttttctttcaacctttttgacccttttgtcaaagattaaatgatggtatttctgtacaataatcatatgatgtggctgtgtcccaacccaaatctcatcttgaattgtagttcccatgattcccacgtgttgtgggagggaccctgtgaaagataattgaatcatgggtgaggttttccctatactgtcctgtggtagtgaataagtctcatgagatctgatggttttataaggggcacctctttcactcggttcccattttctcttttgctgccgccatgtgggacatgcctttttccttccaccaggattgtgggcctccccagccacgtggaactgtgagtccattgaacatctttttctttgtagattgcccagtttctatcaggagcacaaaataaactaataccgatgatatctgtcttttctgttctgttccattgatctaagtgtttattgattggctaatatcatgctatcttgattactgtagctttgcagtaaatcatgaaggctaataggacaagtcttttgactttcttcttattcttttttactactgtatttgtttttccaggtcttgtgccatttgtatgaaatttagaatcagtttgtttccatctacaaaatagcttgccacgattttctttttgtggttacattgaatctacagattaggttgaaggaaattgacatctcaacaatgttatgtcttctaatgcataaacatgaaatattgctccatttattgagatctttgattttttcatcaatgttttatagttttcaacatacaaatcctgtgcatattttgttagatttatatttgagtatatcatttattggatgctattgtaaattataaggttttttttacattttaattccaaatctttgtctttcatgtatgagaaagccatggactttttatattgccctgatatcctgtaaccttgctgtattcacttattattccacctaagcggatctcagctgcatctgctggatgaggtggtgctttatcctataacttctattctctgatgcatccaataaaattcattgattttcactttgtcctgcttttccttgtaagaacaggaataatgaagtccaagctttcacacataggagataaaactgaaagtccacacattctgattttaaaaaatcttctattcttttgttttgctattcatatgtgttttttaaatgtttatgcttgaggtttgaattgtttatgtaatgtagaatccacagataaacacaattagcaaatgtaagctataattcttacagttttaaaggtacctttgtatgtaccccacaaaaaatagatgtcaacaatttggaggctactttttatttaagtaattttacacctgctttctcttttttttaatgaaacccagttgcagttctttgaacaccaggaaaaacttcctagcaacctctgatgtattcctgcatctagagtagaaacacagcacacagcacagtagagaattgaaaaatttgagaaaaagagtcagttgttggccacattgactaagactcaggcacgcacatacacataccaaagtgattagcaccttagttgagctcaaataaggaggaaaaaaaccagcattacaagagtgagacagtggcaggttactactagccctgcctgtggtatttctcttccatttgaccagaaatggcaaattctgttgaaaagaatggcccattttcaggcaaagctttaggaagcacatgatttccacatagaatctggcctttgtcagacatggtatgggactgtaaaaatgacttattccaagatgagaacacatggggtagagctttaaaacctgcaagccatgcgttgttctcttattgaagttttgttaaagctgttccagacatttgctgcctttgcttccatttttggacttgagagagaagaggcatcaagacgtctgcaggggggacatgaataagtgtgtgtgcacatgcgcacctgtgtggatatgtcaaaataataaagtttaataattgatttctataattattaaatatagctttactaattgatagctataattattaaacatagctataattattaaatattaattattttatatgtttagaaaaaatcctatacctttgataatattcatgtgtgcaaaatatattcttctgtcctggtaactgctctgttcataatcatctttttttggacaaacaaagaaaacatatagacaaacaggattaatataaaatttaacaattatatagcaatacagtggctaactatagctactctaattaattacctgttctagagtgattggactatcgcaggtataaaccctagcagggataaaatctttttatttatatgctatataaataaagtatgttctaaaacacttgcatgatttattccacgaatactgcatggatttcgttgcacgtgagaatttctctgcctgttcttcctattaaccactaaatgttatgtcatgctggggatgtgagccctgaagcagtgacaggaaatatctgcaaaatggcaaatgcctcccattactgagagtgctgattacaaagctacaattacatgtggattattcatgtttgcagcaatataatgaactggtttatagtttttcaagaagaaagcatctgtagtatagtaaaaattactctgaatcttggatcaaagaatccgggttccaatccagcctttgttaccagtagctgtgttagttaactattgctgtgtaacaaattatcccaagacttagtggcttaaaacagtaagtatttgttatctcttacagatttgatgggtcaagcatttgggaatggctaaactggacggttctggcttgggatctttcatgaggttacagtgatgatgccagtcagggcagcagccacctgtaggtatgacagtggctgcagcatcggcatccgaggtatcttatttatgtggtattggcagaagatatccactcctcactggcagcttgactggcctcactttttagcagctgactttccccagaatgggagatacaagaaagagagggtgagaaggaaaccataatgcctttttgacctggtcttagacgtcacaagtcaccatttatacacattcagtttattggaagtgagtcactaagggtggtcatacttcagagcaagaaaactagcctcccttgtatgaagtgaggaatgatataaaaaaaagggtgtattttcataccaccatggtggccatatgagcttcagtagttaaacctcgctgaacatcagtcttctccacaaatgaaaataacaatatctacctcaaagaattattggggctgttcagtaagatgatgcatctgacatattttgtaaaatgtaagctattgcatcagtgtaaagttgattgaatgtaatgtcagtgatgttttgtcatagacatcaccaatgcatgttgaggaaatcttgtttagtgacttccaagttaggcagacactggtactgtgcaccctcctctcaaaaaagaagcatgcaaatctttgactgttaaagtatatagcattcaaagattttgttgtaatcattgagaataataatttaattatttatatataattaattattgtttaattattaattaaattattatttaattatatataaatatataattatttaattattatataatgaatcaggtgcagtggttcacgcctgtaatcctaatcccagcactttgggaggccgaggctggtggatctcctgacgtcaggagttcgagaccagcctggccaacatggtaaaaccccgtttctactaaaaatataaaaattagccaagcatggtggtgcatgcctgtaatcccagcaactcaggaggctgagacaggagaatcgcttgaaacccaggaagcggaggttgcagtgagctgacattgcaccactacactccagtctgggcaacaaagcaagactccatctcataaataataataataatttgttaatgaaaaatgttaatttccaaagaatgatagagtttaaatatcagaattatttatcttattatttttggtggattgcctaaatatacagactttgtttttcgtgtttttgtttgttttcccatatgacaagaggctggagactggcaggcaggcagcatgagcttctgcagcagcgcagttctgtgagccatggcccctctgtttctgggtaatcaccctcgtccttggtaccttctgcctgctccccttgcagcactgatccttcattccaggcagatggaataagatcaaagcacaaaaaaaaaagtttgctgaatatgccctgttttattttaatttcttattttcaaataaatttagacttttggaaaaactgtaaagatagtagaaagtttttgtatacttttcatccagattcacttaaggataacgtcttttataatcatggtatatttattgaaatcagaaaaccaacattcactatgagccaattggtattagttacgctataactaattattattaactaatagtatcattatttacttatccacaatacaatgatgtaataacaaaatgtagtatataatattaaatacagcaatgtaggatagtaatgatagtactactgctagttttagttaataatattaactaatttacaggccttattaaaatattttcagttttaccactaatgtctttcttctggttccacgattcacaatgcatttatgtgtcatgtcaccactgttgtctgcaatctgtgccagtccctcactcttttcttgtcttttgcgaacttgaaactcatggagaacgcttggtctgttattgtgtatagaatgcccctcagtttgggttagtctgatgttttcacatgactaaattgaggttatgcagtttttcaaaactgcggcagatgtgatgatactgtgcttttccactatatgatagcatgtgatgtatgagatgtaaacacggatcattgttttcttttcctttttttttttaagacggagtctcgctctgtccccaggccagagttcagtggcatgatctcggctcactttaacctctacctcccaggttcaagcgattctcctgcctcagccttccaagtagctgggattacaagcatgcgccaccacccccagctaatttttgcatttttagtaggacgagatttcaccacgttggccagaatggtctggatctctcaacctcgtgatccacccacctcggccttccaaagtgctgggattataggcatgagccaccatgctcagtggatcattttttttttatgttttgtttgtttgtttgttttgatttctatgttgtctgtcagatgtcttttaagtgatttttttttaaatttataacttgtaagtgtcttctgggaagatatttttaggctatggaaatactctgtttttcatcatacacttgcccactaattttagcatcaataatggcttttgcctgcagtgactacttatgtagtgtttaatgtgatgatttctgtagggatatataaatgagccaatgagaaaccacagacatcacatttctagcttaattctgaaaggtaaacgtctcattggcaaattttaaaaagttaagacaatttggtttcatcaggagacccaaagaaaaaatgagtagtttgaatttctggtcataaggatagtattcttgatcttcttaatatggaagcaactaaatatatttacaacaggaagaactagatatacttgcaaaattcaaagagaaaaccaaagcaatacagccaagttctatttgcaggtcgagatcttccaaagaaatggcagtattgtgatagttatgtacttttaaaactggaaagagatgggaaaggtacaagtggatgttcatcatggcgtagacatcaatacatgatcagtcaagttttacttcttgttttaatgagaagaaaaagctgtgattctttatttattcaaaatcaccatcacttttttctttaaaatagtcagactactagggcctctgatacttattggaagataaagttaaggagagaaaaggggtgtataaagtaaaaatatatggcagctgtccaacaaagtcaataatccactttagggaccccaaaatagattttctggagtgtctgtctgtgcacaagtttgtcagcatttgagagaaatgactgagcagccacaacaaagagtgtttaaacaaaccaatctggatgtcaaaaggttatgtgccgcagagggctgctggtgttaattctatatggattaacaccacagccgtttcttaaaatagaaaaacttgaaagaagtgagtgagctcagagaccttttttttttgtaggaagtctagatgagacatttatttttttctttgaactggtgaagttctctctactcagtgcgactggtgaggttgcatgaaaagtctgtgaatcaatcacaggacccagttctgccctgagacctcaaggagagaggaggctatgctggaccccgtactgtagaggatccccactcctaccctcttgtggacaatgcacccctcggcatggggcaagaagtccaagaacgccataagccaagggaacgtacacacaattagcctgtgtctccttctgcacaatgctttctgcggctcttccttgcagagtgtggagctcatttgcaagagcagatctcttgcttggattcatgttcttgtggtcacaccacaccatccccagtatgggcctctctccagcaaggggatgaggatgttgtttgatcgtggggctaatgtacatgaccactgggaccctccaaggtgtggcaggctaggcaggaatagcagagaattcactacaggggtgtgtgtgtgtgtgtgtgtgtgtttgtgtgtgtgtgtaggtaaggaatatagagcaggaggctttcacaatattccagatggaagacagtgaaatccgccaagcctaaattcaaatcataccaaaaggtataaggagttaagagaagagaataggatataccttacttgtttaacaaattgtttccttttttatataaagtaattttaggtggtaaaatatacagaaaatataaatatatacaaaacctacataaaatttaccattttcatcatttttcagtgtgaaattcagtggctttaagttcattcatgatgttgtacaaccatcggtactatatacagaacattttcataattttaaacgaaacatttgttcctattaaacgctaacttcccaatcccctgtaccctcaggccttggtaaccattattcttccttctgctttcctgcatttgcctattctagatcctgaatatagtggacacatgcagtgttttccctttatgtctagcttctttcctgtagcacagtgttatcaagtttcatccatgttgttgcgtgtatcagtacttcattcacataattttatagataaataatatttcattgcatgtgtgtaccgcatattgcttatccattcattagttgctgggcacttgacttgcttccatgttttaactacagtgaatatgctgctatgaacattgttgtacaagtgtctgcttgagtccctgttttcaattttttggggtatataattaagagtggaattgctggatcagacagaaactgtatgtttaacattttgaagaactgacaagttatcgtttccttggctttcccttatactatttgcacatgtagcatgcagatctccactgtagccctgggtcctgcaaatattattagggacaggacgtgacagcaaccttatggatctatacatgtagacagtaaatcaatccttgtaaatgttagtctttcactttttttcacttttgctttccatattatataaatgagaaatctgggtttccatcagtgttcaaacttggaaacttttgtgtcatattaaaaaaaaaatccaaatcaagctgttttgtggtatttcagatctgactgaaaccaggaagtaatagaaatataaaaagaaaacttgatcttctgaggttttctttaccaaagtaactgggataaaaattaagcctttaaaatttttgaggttcatatatcaatgccactgatttctaaaaaatattgtatgactagcttcttttggaaggtaaaaaaactcagttctcctacaagactttgtagaaattctttgtcttaaatcatatagcttaaaaaatgagccttttaaaactgtgaaggatatcagaaagaaatgtgaagaaagaagaaaagcacaaattaaaagaacgaacaagagctacgttagcagtgagacccaatttaaagagtttgggtccagccagagcttttcaaatcttttgaagcttatacagtgttctgatccctaacaacccatattcttgaaaaattaaccagaaaactagcatgagctaaatgtctttatgtttgaattagagaacagggaaaggtcttgctgcctttagggaaagcttttaatcagaatgtctcttcatcctggcttttgacctttcctaacattcaattgttttttcacactgctcttgaaagagcctgcggctctaagaaagaaggatggatatcttccccttgcttagcacggtttatgtcaagattttgcccttgtaaaagcacctaaatgtgctggtgacagacagagagggatgatcattcaaaagtagtctctgcttttgttaaacttttatttcaaaacaatggagagcacatcccatcactgctacgaaaagttctaacttccaattcataggtcatttttttgaaattgtattttctgattaaaaacacatatttctccaactagtatccatccttatttctagaggtatcaccgtgcatttcgcaccccctaaataaccttcttgccccgtaaaaaatattttgtaagtattcgtatgtacccacagtccataattaggacatctcacttctctttgttaaaaattccttatgtttacagcttttcaaagggctttgcattcactaactaagtagtcggaaacttttgagacagctttgcagaacaagacacaacaactacatgttgagtaacttgctcacggttacatgatagttatgtaagatgcttggtgataggactgggcgctaacatgtttttcccaagaaaaataaacctccattgcatctagtccacactaggacgatgttttgggcatatgtttttccaagcatctggtagggacagatcaggtctaagggatttctgaaaggtttaaattaaataggatttccctttaaaattttgatagagaaatttagaaaaaaaaggaatcaaatgctaattcagaaggtattgagaacaggaaaaatattagcttatcagggaacttcttaaggtcagagtttcactatcacattctagcttcttcagtgcctcctcattttggaaagtgttcaggacttttaggtgcagttctggacacctcacatgtctgaacatatccagtggtctttcttaaagattataaggacttagcagcaaattagtctgtttttcacatggtcggagatggctgaggcttaagaatgctgcacagcatcctgaggtgattattagtactcagaaggcctccccacctctcttgcacctgtgatcctcatcttgcccttttccaaatatcgagcagccaccataatatgtgtgtgtgtgattaatcaattattactaaaggatcagtaatccttaacctctgagattctcactggatattaaggatcttaaaaataggagaataatcaatttaaacctttaagctgttttgcttctgatactattccatgtcttagcattcaatgtatttttattggtggatccatatgacaaagtgaaaaggaggagggttttggaaaaagagatacagaagttcacattttagctacccgataactgtaaaaacaagggcaattctgtattgggcttacatttatcttttcagtggatctatttaatagaaatagaaataaaacacatatcaataattgcaccaagatactgaaggtagtttttattgaaaacttgatcactaaggaattgacagaattgagaagtgagaaaatttcaaagatacacatgcctgaaagcagaaatcatatcttatatgtcaaacatgaaaatcaaagtcagctgcttgaaatgtgggcctaataaatcttgaatctctgcaactgtagggaatagttattgttttctaatctagcacacattttagtaaacttttctgtccttaatgttaaacttcatatttcctacacatcttttttaatgttaattattttaatatgcatgcatatatttaccacttattacatgggaagaaacaattcttaagtctgagaaggttggtaatcatttacatttctgacacaaaactgaaggcatggttgagaattagaataattaaaatagcactgggggacaacctgaaaactgtgactccattctgatagaaggagtcattgtccttgaacaatttgcaaatatgttcccttcttttcccaaatatgttcccttcttttcccataacaggcttccatgctttatgcaactaatgcgttatgaattgcagctctgtttcttacagagaagtgaatttacaaaagacatacctttcacatcatgttcacctttttcacctcaatgacaccctgctcccttctcttaccttccctgacaccacacagttcaccatcagctcttcctccttctcaacaccctaacttctaacctgcaactgaagctcacagttgtgcttagtatctgcgtgacagttcccttcacttgacaagttttaaaagtcaactttctttgtcttacagtttattgtcttcagtcttttatttcccttaccttttaataaaaggattcagtattccatttctattaatcttttattaaagtttattagaaatagaatgctgaatagaaaataggaagtttagctgtagttaagattgtgattattcattatactgatatttttcttatattgtttttgaactgatttatgggtagttagctccaaaactgaaggaatactatgatattttcaacactattaccagcactatgtcaggtattaagtttaatccatgagcagagtgcaatttcaagatcatgaattttcacaaacttcaatgttactactgtgtttatgctgaataaatggtttctttggcacctctttcacacacacacacgcacacatctatacatggtaacataggctaaagcaattagagaagttcaggtatttcaatgactgaatcacaaaaatatgttattgatctcatttgttaatcaatgaatggttaataagaagattaagaagacaaattacaaggtcacagcccattcagctgaagcatgttgttatggccagaggctcatgagaggaaaaggtgtggctaagaacagaagatccgttaagctccaagcctgttcaattatttaagtcactgagacaaagtagatgtggagtgtgagacgccagtgtagagccttcaactgattttccttggggaggttgacctgacttaatagtgtgggaaatcaggtgaattttggctgtgactagatttgaccaagatggagttttccatgaaaatgcaaaccaatctttagaatttgaattccataaagcaaaaaattcttacataaatgcttataattttaccactctaccactgtgggatgcatgccacgagattttgtgagtagttctaaaaagtatgtcttcttggacaacatccaaagtagaccacatgcacactgaaacaagccttacacaatagcttttctatatatgtatctatatctacatctatatttatatctgtatctagctaaaagaaaagctccacatactgatagaattatataaaagcaaatactaacgtttgggaatttcgattataatacacttaattgaaaacaaaacaaaaatattttttaaagtattaagcaagcatagagagacattttggtgcttacaaggatttctgggaatacaagcaattattttttgtcagggaccatatatttaggtacagatcattaacaatgctttctttaatatttatttagtgaattgtacatgttaactctaagggcaattaaaacccataattataatatgagaaactttttctccacttagtattttttattataaatatggctagcattgaatcattggctataaccatgtaattttaatgcttgggaaacatctgttagaaaaactttccctatagaagacatttatcaatgtcctgccttatctctggttatctttggtttattacattttatgataaccataaaactgaaaccatcctcatttacatttttcctcttctaaatttggggaaattatattttaagtgtttatcattatctcattatataatctacagaaataataaacagcagcatacctgattttaaaatgagacttttgaatttctacaataaatagaatataacgaactctgcttctttgggtatatcacgtcaaatatacattaatgagcagatagctttaacatgtttatcatgttataatctgattgttgtctttactaatcaagatacctaatttaactgaagtatcaagtgatctcaaaacctcagtagcatctgataaaggttgctgtctcacctgtgccacatggccattgccatttgactgctgcttcacccacatcacctgcactcccaaactcagcctggctggatatctttttacaagatacctgataatgaaggagagaaggaacatggtgaacactatgcagtctcagaagatctgcttggaagagacatgttacttctgctgtcatttccttggccagagcaagtgaaatgctgaacctgatcagtggcttattgtttgaacagtaatacaacctactgttctatcatagaatgatattggagtcatatatttcaattagccattatcaatgtctctcataattttctttacacattttctcagaatctagagtaaaatttaaaaaaggaaagacagataaatgctctcatctccaaattcagtgtcctaaattccacttactttaatcagtataaaaatcaggtagctcagattttaatggactagtcacttttgtctctttttttttgctatcagcgtttatattgattatttggaagaaaaaagagccccctcaaccttccagagcggacacacacacgtacacacacacatcggcaacattagagaggttgacctgaaagtgttttaaaaactatgacacagttaaactatgatttcaaagtttttccaagcaagttatatgtcagaatatgagtaggggaaaactattgaactgccacaattctgctggtggtttcattggcaattccaattatgttctgatcatagtgtcatcagagcaattagttcatcccaaacttgttttgtattgccactccacagggaaaatagtaaatctgtcctactgactgcagttctctaaaatgtccttaaagtttagttatttcaaacttagtggaagaaatatgttgttggtagtggtcatccttgctagtactctttaatcattacctgccaggaaacactttttatttaccagtgcatgagagtttaggtgagaattattctactaccgaaagctcaagatgtatttgtgctatagttataaatatagattttttttttgtaattctaacttttcaggtacttttctctttagctgttttattttagtatatgtattttttccattttttatggaattgtaaggcatatttggtggttctagtttacaactataacatcatttccagagtcatcaattcctttgtcaggacatgacattatgtttttccattttttagacttcctaaaatgtcttgataaccaaaacacagagggttatcattatacagttatgtatgatacggtttcctctatataatgtgtcacatagagtattttatttccagccaaagatcattattttttaaagaaactcaggaacaagaaataaggatgcactcacacaaatagacagtagtgaattcagaatgcatagcagagtgtgcaaagtaaagcaaatgcatccatgcccaattacctaatttgtaattgcagctattcattgcacttgattctttccttcaactccttcctctccttccctccccggagctcctccttcccagcgtttgtatggcagcttcgtaataaacccagaacacttagcaatttctgctccgatttgctctagcttcaaaggtctatggtcatgattacatgcaataacgatacattcaatgtgaaactacaatctgtgtaactttgtatttctctttgaaggtttagatacgattgactgtgtcaaccataagcagaataataattcctgtgctcagagacaagtcagagagagagagagagagattgacaaacaaacaaacaaacaaacaaacaaacaaaaaacagattttaagaactgagccctaattcatttttttttcttttttattgtggcaaaatacacatgacatttactatcttaaccatttttaaatgaacagtttagtgatattaaatacatatattacattgtgtagacatcaccatcctccatcttcagggttctttccacctttcaaaactgaaattctacccattaaacaattcctcattcccccccttcccccagctcggctgctggcaaacagttctacttattgtctgtatgattttgatcactgtaagtacctcatagaagtgtaatcatacagaatttacctttttgtgatgggcttatttcacttagcatcctaaaggtttgtccatgttgtagtctatgtcagacttggcttcccttttaaggctgaatgatattccattgtatatataaatcacattatatatgttatattctaagcattttatatttttaggccttacatttgggtctttgattcatattcagttaatttttatatggaggttcatataaggttcaacttcattccgttgcatgtggagattcagttttctcagcatctgttgttaaaaatagtgtctttttcccattaaatgatcttgccacccttgtcaaaaataatttggccatgtaagtattttattctattggccaacatgtttgttttacgccagctgatataaccatatgtaattattcacttattagttctgaattcatttattagtttcatatgggattttttggtggaatcataagagttgtctacatatatgattatatcatctatggacagagataagtttacttcttcctttattccaacatatgttctctctttttcttgcctaattgctctagctaggatttccagtactacgttaaatagaagtgaggaaagcagacacccttgctttgttcctgatctgacaggaaaaactttttaaaaaattgtgatgaggtagtttccttctatcctagtatactgagtattgttttaattatgaaaggttattgaattttctcaagtgcttttactgcatcaataaaagatgattacatgtcttttttcttcattagtgtggtgtattccattgttaatgtggtatattccactgtttaatttttgtgtgttgaaccatctttgtattccaggcataaatcctactttgattttcgtatgttgaaccatctttgtattccaggcataaatcctacttagaaatggtgtataattcctttaatatgttgcaaaattcagtttgctagtacttttttgaagattgttcccattaatgttcatacggaatattgatctttagttttctattttttgtgatgtctttgtctgacttgggtatcaaggtagttctggcctcatagaatgtgttaggaagtgttccctcttctttgatattttggaaattattgaaaattggggtgagcccttctttaaatgtttggtagaattcagcaaaaaagccatcaggccaaggacttttgtttgtcaggatatttttgattagtaatctatctcctgactcttaaaatgtctattacaattttctatttgtttgtggtttagatttagtaggctttgcgtttctagaaatttgtccacttcatccaggttattcaatttgttggcatatcattactttcgtaatactctctgctgatctttgtatttatgtagacttggaagtaatgttcctatgttccttttttttttttttattttggtaacttgagtctttcttctttctttctagctaaaggttttctaaatttgttactattttgaagaaccaacttttggtttcatttattttccctattattttacattctctattttatctcagctgtaatatttattatttcattttttttgctagtttcgggttcagtatattcttatttttttagttccttaagttgtaaagttaggttgatgatttaagatctttcttgttttttgtaatgtatgcatctaaattttctaacagtgctttcattatgtcccatatgttttgacatattgtttgttcattttcgtttatctccaagtattttctaatttctcatgtaatttattatttgatccattggtaagagtatgttgtttaatttccacaaatttgtaaaagttctcgtttttcttctgttactgatttcttactttatcccattttgatcagaaaaatgttttgtatgatattttttaccgtaagttttttgagacttaatttgtgacctaatatatgttctatccaggaaaatgttccatgtgtacttaaaataatgtgtatgccatagaaactgggtagagtgttccgtatctgtccattagacctagtcggtgtattgtgccattcaagttctctgttgccttacttatattctgtctcattgttctattcattattgagagtggggtatgataactacaacaattattatagaactgtatgtttctgttttcaattctgtcactttttgcttcatatattttatggtctgttattagatgcataaatatttataatttttatatcttcttgctacattaaaccttttaataatatataatgtccttcttgtatgttttaaaatctactttgtctgatattagtatagccactcttgctcttcttcacttactatttggacaaaatatattttttcatcctttaactttcagtgtatctgtgtctttgggtctaaagtgagtctattgtagactgggcctacatcattttttaaaatccattttactaacctctgtcttctgattggagagcttaatccatttacacttaaaatcattgctgataagcaagcaattttgctatttgttttttatatgccttatagctttctcatacctcattttctacatttctgtgttttgtgtttagttcatctagttgatttttcagttaaatattaaaagtctttttttctgctattttctttcttctatattctttgttgttaccatggtgattatattcaacatgctaaagttataacattctaatttgaatttgtgccaacttaattttaataatacactcaaatattttttacagctctgtccccacctctttcagctgttcatgctataaaattatatcttatacatttcatgttcgaaaacataaactaataattctttgatgcattcatctctcaaattatgtagaaaacaaaatgtggaattgcaaaccaaaattacaataccaacttttagcataataattatcttaatgttttagtgtcttaaatgaagtagaaaacaaaatgaagttatacagcgtgttacaataatactagcttttaaaattgcctatttttaattcagatttaatttttgtatagcttttagttattgtctagggtcctttaatttcatcccaaataactcccctgagcatttcttgcagggaaggtctagaggtaataaactcccccagcttttgtttacctggaatgccttaatttctccctcattttagataacagttttgctgaatctagtattgttggttgacagtattttacacttagtattttgtatgccttctgattttcacttgaaaactgagcatttgaatctaataatatgttaactctgataaccggattctctttctttctgagggtttgctgttttgttcttgacttttttttattgttgcagctgtctctgtgccaagtattagcatgaggtgtaaacttattctctcctcaggtttttttctgaacttgtatcttcccactgtgtctacatggtgacttcctaatttcacccatatatacagttgcttgtgaatgtctttatcttcaatgtcagccgtccaaaagagtaaaaagagaaaaacaaagggagaaaaaatgaggcaccaccctctttacattccctgggaaccacctcagccaggggagaggggctgacaataattgaggaggagcataacaatggccactgtttctttgtctgcacctctgggatcagaagcagtgatcagtgatcagagcacgggtctctgttatctggcaggcagggttgtttgttgcccaccctagtttctgcaagctgtgtggtagctgctccaggcaccgctgcctgccacagagttgagaggtggggaatgaataggtgctattgtgctaatagctaaaattgaccacaattaaccacaactgacagtctaagccatctcctgggagtttgaagtgcaagtctttccctggaacttaatttcaatagtttccagaattccaaaatagtaacatcagacagattctgtcagggcattatttttttctatgtagggatacatatttctagtgctacctactccaccatctttctagaatattctcctccccaataatttatatcatcatttctggggttgtaagtcaacaatctgtattttaacaatttctctaggtgtctctttgcctgctttaagttttcaatccagttagccctctctatcctcaatataaaacaaaagcaccatgaaaacatttggctctaagtgtggttgccatttaatttatgttccaaaccagaaaaaaaaaaattgagagtaaaagaacgtgctattaataattcatctgtaataatatatatgaacctggactgtctgaaacagttttttgagagacacttagaaaaaattatgctttggaaattttttatggggtgtcattaatttgtttttgtccaatttttgcaacaaaattttgacttctatagtgaggtgacattcataaatctgagtattcatatctaaaaacccaaaagcatttttttctaaggatgtcatgtagatcatataaaataactatagaaatattgaatccataatatgtcatatgagttgcagccattttaatattttgtccatttttatatattctatgcatataatatatggtagttttctgatagtaatttccaattcctctcccaaaatggactggacagatttcttagtgagggaagactgtttttatatcattcaaattttatcagtccttttctgtgggtcccctgctgttcttattccatagcatcttatgtaggattgatctcttccttgtgttagagtcaatattattattttcagaagtcttggtttttccattggcaaatgttcaaataaaactttataaccaaatctttataatgctgttgccaactttgtgtctttaaataaagtccaattgccatagggcaattgtgcagtgggatggatatgtgaatctgtgtgaaaaatgatattttaaatgctttgtggggaagagtaaccagtctggattgaattgaatgctaaattggctttacatttggaaaaaatttagatgttatagtagttcttatataagaacattaaacatctcactctaaatgaagtacctcaggtgatactgtgatagctataattgtttatgacggaaatattcactcttagaagacttgggtattgacaagaacttggaaaaggatcaagcagcaacatatatgaaactgtgcttcagcaggggaaatacagttatgttcctgggtcactggactcttgttatggactgaacaatccaagctatataaagagacataataactatgatcagaactttgtgaaatatgaccgttctatttgaattcaggttctaagcagtattccccaaagagatctgatattgaatcaatgttgtagctaccagccttgaagttacctgaactttggtattctattattcccttagcttgtagaaactgactatggtgaattcttaccccaaatgtatttttccctagtagatgaactataatctttcttattcatagtctatgattggtgcatcttctctagctcccttttttagatgtgctgaggaagtccgctgtggtcctaaagctgcacctgtgtggctgttgtctaatgtcccgttttggtgctcaatgtcatgagtactaagatgattctgagtaagagtcctaattaatgccaccaaaatttggcgaacccttgtcttttggggaagaggggcagaattcttcacgatatgcctcaaacctggcttcttcacttctgtgtacgagataatttcaaactgcttttctcacttttaaattttattcatagatgtaaaattttggcattttggctaatttaatttcaaatttgtatttgcttgttcctgctttgatgcgctacttatgttgtgtttgaaacatagtagaaaagaggctgcgtcggacaagtatgagaagacatgcttacagtcacataaaaggagaataaaaatatgtgtgtgactgtagaccgtacctccatgaacattacaaatttctgactgccatctagaacacgtgctttatcaacatgatatcaatgatgtggatattttacttactttctattttgttatacatgtttggtttagatgtgacctttgaccatttctgtataattttaataaaatagatttaactacacaaaaatcaccctaaaagtaattttccatgatgcattttaaaggtcatgttttccctgatgacagcatgtttttgtagttagaccttgggaaagacaacaaggagatctgagagctaatgcaaaattatctttactagctggatctccttggactggtcatttatcctctgaatcctaatttgccccttagcactcacaaatgtcatctccccaaagccatagctgagcagaaagtggagcttagcattttttattctgatagaagagactgtgtccatgcaattatgacagtaaaaataaatgagcatagcttcaaacatttctttaatagaaacttagcctttgggtttaaggttatataaagtgaaaggaatttgggtaattaatatgaagtcaaacattaaaagattcctcaagtaatccaaaggtatcaaatgttcaatgacataaaatacctctctagtccttatgatgagaagagaaggtcctgatgagtggctaagtagtgatgaaagtctaaggctaaatttctatgaagaaatattgtaataaaatttttgaaagatactcagagatatttcttgagatcattatcatgtattctgtacacaaatgtattctttccattttattttcagtgattttccatgtacagctataactttagaaaggctgattgttattctttggcttttctccctcaattaaatcatgtttttttggtggaaagagagatttaaaataaaatggaagcaagtggtattaattcagagttactaaaactgaaaattagggaaatgtagaaaatataaactaatatcaagctaattcttttctgtatcagtgttagaccttttatgggtgaatgaggttaaatgtgtgttagtataaaggatgtaaaggagtaagcaaagacactaagaccagagcatgactttatatctatatcagcttgagtctatttatagtagaatcactagaaagtggtgaccacacagagttgcatttttttcttttgatatgcatacattttccctgaaagaaaaaaggaaggaaggaaggaaggaaggaaggaaggaaggaaggaaggaaggaaggaaggaaagatggaaggaaggaaggaaggaatgaaggaaggaaggaaggaaggaaagaaggaaggaaagattgaggtaaggaagaaaggaaggaagggagggagaaagggaagaaggaagaaagaaggaaggaaggaaggaaagaaggaaggaaagatggaaggaaggaaggaaggaatgaaggaaggaaggaaggaaggaaagaaggaaggaatgaaggaaggaaggaaggaaggaaagatggaaggaaggaaggagggagcaaggaaggagggagggaggaagggagggagggaagaaggagggagggaggaaggagggagggaggaaggaagaatattttttaaaaagaaactctttgatgattcaacatcatggagaagttattattatattgagcttgacctggatctgtaactcttgacatttagctcttgaaaatacatctgttttcttggctgatagtcttaaaagacagaatccaacataataagcctgcacatgtatccccatatctaaaatgaatgttgaaattataaaataaaatacaatatatgttcacaaatattaaaaaaatgtgcagagatatgggaatacatatgtgtcttatgtgtgcttatttctatgaagtcgttagatgtcaaagctctttctgcatgcatccttgcttagacgttttgtctgaaattctgttcacattgacatacgtgcattaaactaatatgagaatgtatgcattaaactagcttgaatgatgtccacattctcagttttttcatcataactttttctttccagagtgcatgatgccgcagaaaagaaaagctaactgtgaaactcaaagaaagtctttgttagggcctgagtattttttttttaatctctatgactttcacattcttagcttcagtaatccttgaagagaacagagtcaaaccttgtattttaattaggatctttcagtgtttgtggccttgaggagcgagagcaagaaagacattctatgggtgtgcgtgaaagagaggaccaaggttgttttctttgtgactagagattatattgtgtaagagcagatgacaaccttgagattcgatttgtgatatgaaaccaaatgcactaaaaggaaagcgtaccagtttggattagatacattaaatcagtatgtcatgtaaatcagtgactattaaaagagaatatataggagaaaaaggtattagaagttgcattttttaaccaattgcaacgtttgcaaatgggcttgtcacataccatcatgtaagtactagtgaagtctaaggtataagcaagtatttttcatttttaaggatcattgcaaagatagagaatttgacaataaatgaactgactggccttctacaagtatttacttacaaccacaattgtaatttttccatggccaagctatgaattattaaaagaatattgacattttgctatatttttaaattatctttaaatcatttcaaatagtgaaatagtattatactaattaaactttattaagtacattttcaagctcagctaagttttttaatcaatgtttatttcagttaggggatagttttgttttttttcttctttgaaataatatctttgaaaccaatgtccacatttctttacagataaaagagttctgtttatgaaataagaataaacagcctgtaattttaatatcaccaaaactattttaatctctttttggatatgtacttcaacttaaactacatatatagctatagatatatagatatgtctatatctagatgtagacacatcccccaaaacctatagaaatgtatttctcaaatgtgtaaagtatagtgaaactgccagaccacaagcgatgttttgtatttatagatctacttgcaatttggggtgtgccaaatccccacaccttgttgtcaatattagtttaacaaaactaaaaggaaatttaaaatattaagatcatcctctttaggatctacttggagcgctgaaaaaggtgtgaaaatactgatctcggacttcttgtgagtttgatgtgttttacatttgtaatgctattctcttcactgcattcatgcgtgtgcttgaagcttgctgccttgtaggagacaatgcaacaactcttaccaatgccacttttataagattttgcctgcagtgtgtcaatgtgactcttcagtacgctacttaagggagtgcaggcaagatgacctaccctgagtcatccaaagaatatttctctagttcctgttggtcctgtgaattcctaatgtctttataataaatggccacctaaaaattaatgtaactgggttgattgtgttgcatgacattaagtaaacctaactgccgcaacagggtgcagtctgcatcatagcaaatacgttacgggagagaggggcacgtcctccctcagcgcccacaacagggatcattaaccaaggctgacacaattctccagtgagaacagatgtaaccttggaatctttctccacacagtgctccaggaagcgattcgacatgagtctgtactggcataggaaaataaaactggcatggctgccacatagatcctattttcttttgcctcttaccaagagttattttaaaaatgaaactattgtcggccaggcgtggtgactcacgcctgtaatcccagcactttgagaggccaaggcaggcagatcacgaggtcaggagatcgagaccatcctggctaacacagtgaaaccccgtctctagtaaaaatacaaaaaaattagctgggcgtggtggcgggcacctgtagtcccagctacttgggaggctgaggcaggagaatggcgtgaacctgggaggtggaggttgcaatgagcagatatcatgccactctattccagcttgggcgaaaaagtgagactgtgtctcaaaaaaaaaaaaaaaaagaaactattgtcaaccaatgagtgtaaaggtgttatttttgcttttttttaagtttatgttttgaaatcctctctcaattgcaggaaaaaaaataagatacagaatataaagagacagcataaatgatagaaaacaaaataagcatgttcatgagccagaaatcaagaagaaaaggcaatgataaaaagggctgaagccggaggcatcccaggccctgggtctggaagcaggtactcacagtggcattcttgggcactctggggcaccgaggtctgtaagtaccactcataacgtgactggccagcaaaatttactgcttaacataaacaatgtcttggcccccaccttgcaaaataatgctgaaataaaaggtgttactgatcattgtctgggactaaggtttagtgaggtttacttacagaaaataaaaaagcaaacagtcatacacccaagattgggccaagctgcctgttggatttgacatatcctgcaatcacagggaaaaggttggtactatactgagatgtggctcaggatgggagaccacagggcaggcaggaaggaggcaaaagcaatctagaagacctgtgtgactagtgagaaaagcaagagtaagagaaaggaagaaagagagaagatggatgtcctcttgttaaaataaatgtactaaaacaaatagaacaatatgaaaagaccctacataggttaagtatcttccaaaaaagacacagcattcatgtgagcttcatattgctactatagcaaattgccacaaacttagtagcttaacacaacatgcattcattactttacagcagcttagacatccaacatggggcccactgggctcaaatccaggtgttggcagagctgcttttctttctgagactctagagaaaaatygtttgctttggtttttcagctctggaggctgctgcgttccttggctcttggctgcctctccatcttcaaagtgcatcactgcagcctgcgcttcatccatcacgttggctctgtcgctcacatttctacttctctcttgcaaggacccttgggattctattggactcacctggataatccaagataatcttcatcttaaaatccttaatttagtcacacacagaaaatcacctctgttatgtaaagtaacatatttccatatcctggaggaagggggcattgatgtgtctaccacagcatccacaaagggaacaaaaaatattgtccaataaatgcatatagaaataaatttgtggattcaggaaaaagtggagtcatggaacaaaaatatttaatagatagaagagtttccagactagacatccaggaaagaattcacccaggatgcagcttagagaaaatgccaaggaatatgcgaaggaattgcatgcatgtacatgcgcgcgcgcgcacacacacacacacacacacacacacacacaccacatagaaaagaacaattcacagataggaggggtagatttagagactccgacatataaccatgaggtttacaataaaaagaataaaggagaaacaatactgaaaaaagtaaggaattttccacaattgaagaaaaacatgagccttcagataggatgtgcgtgtctcgtactgagaaaaataaatgaaaataaatccgcacagaggcacaaagtaatgaaattgtagcacgtcaaaatccatattctctttgggtttgacaggaggaataaattcaagagatgtattttacaatagggtaactacagttaataatatttattatactcttgaaagttgctgagtagattttaaatgctcttactataaaaatgataagtatattaaataatgcatatattaattagcttgatgtagccattctacagtatataagtatttcaaaacaacgttttgtacatgataaatacatagtcaaaataatttaagaatttttaaatgataaaaaatacattttaaaaattggaaggccatattcttaaaaactaaacatgagaaaagtattaccaacaaaaaataacaattaggcctctctagaaacctaactcttaaaaacagacattacagaatactttcaaaatgctttggcaaaaacaaaaaaccaaataacagggaaagagctctatgaattaaaaattttgcactcagataaagcattaatcaagatgaaatacaaaatgaagtacatggtttcttacagctcagttttcctatctggattaactttagttttgcaatagtatttcttgcagtaacgttctattatttgtgtgtccaaacatgcatatttatccagcaactaattcaaggtatgagaggaatgaagatactgatgacagaaattagagcagggaatcagaagagagaagtgcatgttcccttgcatggcactcttcagttgacaaaaggacatgtgatcccaagatttctcttgactgagactacatttacacaaattaaggagttgtgtaacattaaataaccaaagtcatagccttaggaacttccattgcaaaaaaggagtttaacatggagctgttgttaaagggagggtcagatggtcgaaaaattaattggcaaacaagttgattgcataagctggaagtactgttgaaaactttgtggttctttattaaacgaaaacacttcggatattgggaagacagcaacagtgaaatttccttggaatcaggaataagggcctttatatattctactcactgtctacatggtcatgatctcaagttattgtttctcatacatatcagagatgtgctaaaatttgaaataggttttcaatcaggagccaattctaatcacacatcagtggcaacttggagccttgagtttggaaagattttctttagtgtgttaggttgttcttgtgttgctataaagcaatatctgagactgggtaatttgtaaaaagagaggtttaattggctcacagttcttcaggccgtacaggtagcatagcaccgacatctgctcctggggagtcttgaaaaagaaggcaaagggtcagcaggtgtctcacatggcaggagcaggagcaagagtagggagaagtgccacacttttaaacaatcagatcccttaagaactcactcactattgcaaggacagcaccaaggggatgatgttacaacactcatgagaaatctatcaccatggtctaatcacctcccaccaagtctcacctccaacattggggattacatgtcagtgtgagactcaaagaagacacatatctgaactatatcatgtacaattccaagacaaagtctactaaagtctgagatcaattaattgtagatatctgtcattaggtaactgaaatagaaggaatggccacagaggtcttgtaggtttgtggcttgtgcaggtgtctgctgataaatgtttaacaataggttttcataggtggtcagggaaggccttatttgtagcatttgccaatctccctgatataaatattccaaccatggatgatttactcacaagatggaactgaattctgaccacagctgtctcttgctagctggtgtgagtcagctccagaacctcaggagtctggtggcttaatgctgaaacttagtatttaaagttgttatcttttgttcacctgtacggaagtaaagtatgggtgtgagaaaagtttcagttagtttagttagtatttataagaaagagtttaaaagaaaagaatggaaatggctcgtgggtcgcataattgagactatgaagagtggttgaataaattggtgtgttttatcctggagaggagggagctggagagtgatttaataatcttcatatttatggaggttttttttttttgacagaagatggttcccagttactttccatccctaagtttcaaatcaagataaatctagccttaagtattcccctttcctatccaataattatcgctttaaaaatattttagaaaaaaatgtactgtataaagaatgctttcttagattggttatcagttgatccagtttctacactttaaatcctgctggccttttacactatatgtaagattaggcaataaagatagggaaggttcaagggaaaacttctgaggccaagtaatccaataggaatccaatagcaatatgggaaggcaggaactattttacccaataactctagctagaaatttcaacaatcaccaaccattcctgctcccccacatgtcattcatcacactgcttcatgaattctaactccagaagtcctcttgaatttttcccagcctgtcctgtcaaatcgctggtctagtgcaagctactctttataatattgcaatctgttcttattccactttaaataaacagagtagagaattgttgaccagatgaataaaaagttggccaccaatttgacattatccccctaactaacattatcttaaagtatgcttctcaggagggcattttaagtcatttgaagttctaaatgcaagactgaatatcttctgcacctgttttcattggttcaatatgaaagattatactatttccaccatgttaccaaatatgattggcattgtgttaaatgttcttaggtttaatcactctgaatcctttgcctaaaatgtagatttttttttttgctataaaaaagacattagagtctatgccaaaatttgcaattcttctataaaattattttttgtctaaatcttaaaaataacttaaaatcactaaatgttcagggaaatctctagtgagaaaaataaaatttatagctcacagactagattgaacagacaaccatctgttcaacttaaaacatttgtctcaaataacataataactcacaaatgatgatggattaggtaacttcatttcatatttattaaattattaacccaactctttttaaagccatcaatttgcatgaagcttatgagtgagagatatacaaaaaaaacttaatatttgatgatctcctaatatgtgctaggtgctttatatgtatgacattttaacaaatatttaagtcagatactatctcttttttcagataaagaaattgagacttaaggtaaataatttacttacagtcacaaaaatgaagtacgcttatacaatctgaatctactgatggcttcaaaatccttttctacgatgaaatgtagcttcatgtaggggagtataacatggaaataaggcaggtagtttttcctttccaaatttttagtatagatgaagaaaaagacattctcaattatcaatactgtttaaaaacaatgtctttgatttaatatatggtaaatattaaatatgtggtcgtgaaaataagtatatttttagagttcaaaggggaggaaaatatcctttgtaagctggggcattttcaatattcaattttatttattttttataatgaaatagtcagcactccaaccatccatctatccaccaattcatccatttatctacctgtccatctattcatccatccaaacatctatgtatccatccattcacacatccattatttcatcctgcattcatacatccataactactctctaagaaagaagaaaaatttattcaggcttctatgtagatggaagtgttttgatactaaaatgtggatgtttgtaattttattattgccatttcctttccaaatgtatgccaatcatacatttttctaagacttatacattacctctgaaatgcttcctcttggaaatgatgcacgtcacttctactgacattttattggtcaaagcacatcacatagtcatgcctgagcctatcctcaggaagacaaggccatttgaccaggaaacacaggagatccagaaatattggtgaacactggtaacgtccatcaggctgaaaaaatgtggtataaatattaatatttaagacacaaagaggtatttaccatgataaaacatatttaagacaaaggtttttactaagagcaaaaacataaactttgtgttagtcagttctgtctactctaacagaataccatagactgggtggctttaacagcagacatttatttctcagccagttctgatggctggaagtctgagatcagggtgacagcttctcttgaggaccatccttctggctgcacactgctgacttctccttgtatgcttaagtggcagatagcagcgacttcctggagtgacaagggcttcaatcccattcgcgagggctccgcctcatgagctaatcacccaaagtctccacctcctaataccaacaccttgaggattagaatttcaaaatatgaactttggggcacacaaatatttagtccataacagccttggaggtaaaattctaagtagcagaaatctttcatctcttctaaaactaacactagtggaaaacataatctttcattcaacgcttagagtctgtcttggagagcaggaacagatgtattatattacatgtgcacacatacacatatacacacaaacatttgtttgtatgtgtgtgcttatgtggatatctatatgtcatatatacactgcatctagcacaataggtaattgctatgtcagggcacatttattatagttttctctctaactcataagggagagttttttaatcagctggtaatatcatatatttcagttttttcttgcaaataagagtggaatagaaagattttcgctgttgagaattgtgcccttaagtgttaacaatattcacaagtgtttaaagaaataattaggttcatttcattctatcatgcttgtactatatttataacatgacctttgttctatttatatatacaagtaatatattctaataggaatttttttgtgaagaagaaacacttgataatatcccaattccctaacagaattatacaatagttcctcaatgaccttaccttgggaaaaaattaaatgaaagacacctgcattagagatcaatttcctgatgctcagtttatattcatcatgctaagctatccaaggacacctttcttgtcctatcatttgatggaaacgatttccatgtgttttatgattcaactccattctgccttagacaatacagtcacttcaaacagttcaactctacagttggctggctgactttgccttgtaaaaattgctttttttttttttggttcagagtattctatattttacctaagaagtggaaaacaaattttgggcaagaatagtggcatacacattacagagtgatttcacatttcaatattatttacaaatatgacatcaaacattagtggttttatttcatttttatatcagaggcattctaaatatgatgtgacaaagttaactccgaatttcctggtttttgtcagtttaacccagatctttgctatgcagttctgaacactgccatgctttcaacttttcaacaagaaacaggtggttaatacacacatgtaactctacaacttgatcttagcatttcatgtaatactttggtaatgcctaaatattatgtttgtagttgtccggagcatcttattttcactttttcaattctatcaaagagtacattaatagaaaattaaccaaaactgaataagaataaaacctcacttccctaatttatcctcttatagaaaaatattttcagtgtttatatttatgtgataccagccgcatctgggttcagtaagcacgtgtttcgagcatactttgagatgcattgttccttggcgcacctcagtttgtactggaatcattaatgcataatctgaagttgtgattattgagatttttcactcaataatgggattcaaatgctgccctgtttgatctgcattaactgtttggaattccagaatattgactggcacttcagaagtcaccagagtattctgtagccttcagagggtaaatttcagtcacgtggggatgatttttttggcaaagagcattttgcactctgagtcatcacacacattctcacaagtttttaagcccaggacagtctccattccaccacttgtaggtaaactggtgatgattttaaaggtaatgtcagcctgagaaacagtgaaatatgctgaagatatggacacaggcacggagtctgcgtcatcttagtccctaactctcaccttagtgaattgttccaacaatgacataatgaattatatttaacttttcctgctgctcatgttttgatatttgtcatcaatcggagctggtgagagttttaataaagtgcttagcatcacctgagggtaaatttctatatcctttggattccttgatcctcctctgcactttatgtaatgagtgacctttctatctagttcaaatagagaatgtagagaagtaaagtgcttcatgcaagagggcatcactgatgtcaaaatgcagggccaacatgaaagaagggcagaaaggttccggacacaaagggcagggcactgcctggactggctagtgtcggggtttcagccagaaccttcctttagaatttggaaactatggagaaaacacagtgatgcagatcaatatataccagttttgttacagatgttgaagaaggtggctcactactgtgatcatacatttgggcttcccaactttttctcttgaattaaacatattactaaattggcaggcttttttcctaacaactgtgaaatgctagtctttagaaattttcagcatccagcagcaaataacatgcatgtccaacggcgaggatggctccaaaaaagagagaaccccaaatgaaaatgagtcaagcattcttttttctttaagcagagcaagatcattcttatcagaggaaattgtgagcagggtacaagaagctgcacatgcctaggaggtgagagttctgtctactccagggaaaaatgagaagtgttgaacaagcagcactcccagaaaataacacattgtagtagacgcccgttacggtttctccatgtattaaattggtttataacattgtctttttgtttgtctcttttgagtttataagttcccatcaatattttatttcctttacttattttgggtttaatttgtgcttttttctatctttaagataaaagcatagatgataactgattttagactttgcttattttctaatataggcatttaaagatgaaagtttcctcttacaactgatttagctgtattcttcaaattttacctttcaaaattttatagggtttatttttattattgttcaatttgaaatatttcctaatttcccttgtcagttccacttttacatacagattatttaaaattatgttgcttcccaaatatttgggaatttttacagatatattatactattgtttgtgatttctaatagaataccattatagtcagagaaaaatgtcatgtattatttcaatccttttaaatttatcacaacttgctttgtggttgagatggtgatctacctgagggaatgttttatatgcatagaacagataaagtgtattcttcaattgttgaatataatgttctatatgtgtcatttagactaatattgatattgttgaagtcttctaggtccttattaattttttatctattagttatattaattgctgaaaaagcatgtttaatgtctgtgattggagtcttttctgtaattctccttcagttttttaaattgttacatttatgtagtttaaagctttgtgattatatttatccacatatttaattggaaatttttgttgttttaaaaatgtttaccctttctggggctttttcttccttccaacctggtatttttcctcttcagcctgaagaagttacctcagcattttttatagaacaggtctgctccagacgattcagatttttctggtgaacatataaaaatatacagaaatgcttttaaggcattgtctcaggatatttgctatcatgtttacagtcttttatcttctactatctttcaacttttttttttttttttttttttgagacggagtctcactctgtcgcccaggctggagtgcagtggcgcgatctcggctcactgcaagctccgcctcccgggttcatgccattctcctgcctcagcctcccgagtagctgggactacaggcgcccgccaccgctcccggctaattttttttttttttttttttgtatgtttagtggagacggggtttcacagtgttagccaggatagtctcaatctcctgaccttgtgatctgcccgccttggcctcccaaagtgctgggattacaggcgtgagccactgcacccggccatctttcaacaatttaaaaacattttatggtcttctagtttcattcatcttatgagcacaatgcgtgttttttatctcctccagcctctttcaagattttctattcatgtttggttttcatcaccgatttgatgatcgtttgcctagttcttgttatatttgaatgtatttactgtttcttatatatgtgagttgatatatttcatctaatttagaaaattgtcacccatgttctcttcaaaaatgtcttctacctcattatctgtcctctttttacaagacccttaacgtaaatatatttgatggcataatattttctacacatctcagatggctctccttttcgtttttattttattttattttattttatttttgagaggagtctcactctgtcacccaggctggagtgcagtggtgcaatctcggctcactgaaacctctacctcctgggttcaagtgattctgctgcctcagcctcccgagtagctgggactacaggtgcctgccaccatgcccagctaattttgtattttaatagagatggggtttcaccatgttggtcaggctggtctcgaactcctgacctcagatgatacacccaccttggcctgccaaagtactgggattacaggcatggctctcctttccttcttctcttctgtatttttctccttcttcctctccatctctccctccctccttttttttttcttatatttcaatgtgggtgatttctattgatctatcttcttgtttactgattcttttctttggtatgccagtttactaatagacctgtccaattaattccccatctcaatattttattttttttccctattcttgacatttggctttttagttgtgtttatttctctgctaaaattcttcattttttttctgaaaaattgtctaaaaatagtgttagattatctgacatatctattatatttaatataaaactcctctctgataatttcaacatctatatttggaactgcctctatttctctttcttcccttgcccatatggcatagttatgtttatacatcctataatgtatatatatatagcttcttcatgtcttgtaattttttacgatcccttccatttaacagggcatgagatctaagcaagggagagcctcggatttctctttgggctttataacccagctgctgactccctgagtccgggcttccagtgaattctctttgctgtctggttgctcacccagccttttcacaactcagatttctacgctttgctgctcagctctgagcctttgaggcttgagtggactcagtgaagtccccgggagccttggaggtgtttcccactgctgtcctactctacccagctttccgcaacagctttttggcttagagggttttctcatggctctcctgagctgctcccagcctcaagtcagctatataagcctccatttttcagatcccctactgtgcccccaaacttgggtgcattatgtccatgtactaaagtaaaggccccctgggacagagaggtgggtgggtgcagagctgcctctgatggagcttcctcagggacctgagtcatcacacttcataagctttttaaaatgtgttgaaaattggacttgtttctcacatccctttgctggcaaatccctcctcctcttcccatcactccacctagcatcagggaagcacttcattcctctctcataggaagagatcatgactttctagattttctttcagttaggctttttttgcatctccagctcttcattggctcttataaactgtgttttgttattgttgttttcaagttatccatcttgttctcatttgtagttctcttatggctttctaattcctaaccagaagtggaaactgctagctattgtttataacatggtccatttgcagtttataggggtggtatatgaatcaagtgtggaaaggaccagaaaaaaattgtaatggcagatgttatgttgtcttaagccttgctttgcttttgccactgaggctgtgttgtttttaatcttactgtgcatggcaccttctcatcacactagtgttttgccttccaggggtatcatccatataaataaactgctggaaggccaggcgtggtggctaacacctgtaatctcagcattttgggagatgaggcaggtggatcacttgaggtcaggacttcgagatcagcctggccaacatggtgaaactcgtctctactaaaaatacaaaaatgagccaggtctggtggcacacgcctgtagtcccagctactcagaaggctgaggctggagaatcacttgaacctgggaggtggaggttgcggtcagccaacgttgctccactgcacttcagcctgggcagcagagcaaaactccatctcaaaaaataaaagtgaataaaaaataaaaataaactgctggaagaagtttatgaggtatcctaagacatgtacaaatactagtgtaagacccaactgggaatctttatgtcttatttcgtccacagctccccacccacaccatggatttaagaaagtcttttaaaacatttgtagatcaagctatctggttctaaaacatttgtagatcaagctatctggttttcaaggaatttatattaagattgattttcaaatcctgtgtgctctagtctaggaggataattatttgttaatgtagatatttcatagagacttcaggcaaacacatgaatgaggagcaaggaaagacccaaagaaagcatgtaagtagatatcctaaatcaaattgttatttgaccaaagaatttggtgatatgataaaatccaatttctaaataatgagtttttctgttaaagctctcaatatgaattaggaaagccttcagctacacgtaaaagaaaatctaactcatagagttttaaacaaatgatgagtcttttctttttccttaaatctcctggaatcctgttgacattggattagcaacaatggtgtcaaggactgaaagctagtgattgcttttgctttagacttcatgcctacattcaaaacaagaagagggtaggatacagcgtcattcattctgcatcatcaggaaagcaaaaagccttcctagaagcctcttggcagtcatatacttaacacctttttggcagaaactgggtcatgtgtccgtgtctaggtgtgagagagggatggaaggtgggaacatggagttgttaggccaattgtatttcatctcttgggaatggggggattgatattgggtagacaaaaatcagttgttatcactctacctaagtgttcctctgaaatatattacttgattctggaactttatttgaaaagttatttgatattcaatagttataatggtaatccaatacaaaatatatatgttgcctttaaaatgataaatagcaatttaatatctagagtaatctcatctacatttgacagtaatattaactattctattctcataaatcttgtatcatttttttgttaaattgtcattaatttaagtaaggaaaagtagagtttatttcccagtcacaaatagaagtaaccggttgttgtaaaattatcaatgtttctttcttgaaccactgcaccttgaattttgattaaagagtcgaagtattgttaacatccgtggaacttagaaaaaataccagtgctaaccacatcacatctaaaatataagcacatttcaaatttatgtgaattttaaataatctgttttctttggcttgtagaaaaattaccaaatagcatattgtattaagaatgaaatgttctgtaatcaagatcaaattacaatcttataataataacagataattgtatacatgcaatattaaagtatatgagcatattctttagacaaaatatccaaagacatcaatgttttcattattaaagagttactttccagttcactgaataaatgaaaatattaagaatttggttatattaagaataaactctaagatgtttcttttacttcagtatgaaaagcatgcaaaaatgataactacattttgttatgatggtttgaaaaatctggcataatttaaaagcaactttccatctggctggtgcagtaagcaagtggaattagaagagttggtctctgtttcttgatgtgaatgattgtgattagtctgatttctttggtttgcttttattactgttttcacttcttttcttggtatatgtgtgtggatatgcatacaggatgacatttctatcacattatggcttaacaaataaaacagaaaatatgtttactttggatgtgtgtgtatttttggagacggtatttgttgcctactcaacagtgttctttttacttcttggcagcctccttggtataaccacgcatttacggaagatgacgttaccagcagccctggggtaagtctcagtcatccgaagccagtcttggtaatcccagcagactagcaagggaacacaacctagttctgtcaagtggaaagtgaagagagctgtgctgggaggcttctcagaaaaggtttcttttggcaaaagaaagagaggggggaacagttctttttcttctgccggacaaggtcatgtgtgtacgtaagaactggaagttctcatgcccactgagcatggggagagtcctgtctagggtgacctggtgagaacagacaacccttgagccaccttaccctaggaactcctggtgataagacagaatacattttttctcactgttaaactcttttttattatttgtagctgggtgcctccaaaccaatataattagccgtatgtaaatattctgaaatctctgtcaattcaaataacatttagggtttttttcccagtgatcaaaaatacagcatctcaagcaatattgtgtgtgtgtgtgtgtgtgtgtgtgtgtgtgtgtgatattattacataataattggaagacttttgatgtagatcctagtggtgatcttaaatgttgagtatttgactttttttagcatttaataattgtcacaataaatttatatggagagatattttaattatagaaactcattagtttgtccataatgtaaaagagttaaataatatagttctgttgataatgatattttgtaatagatatttttaagctgttaggcatgaaggaaaataatgttgtaagtaatcagttttatatagggtttatagatatttttattatttggtattgtcatgttgtttcatgcctcataatagctgattacaaatagattttaatcaatcactctctttattccaaaggtttaagcagataaagaatacagagaatgcttgtaaagcattttctaccaatatattaggaccatttctggataaggtccttgacttcttcttttaatcgtttctaaaataacatttccaaaaacctcaagcaaaaccactttaaaaaatctgaattcatataattttacctaatgtggaagattgggagagcagtgactttaatataatattttaatgtcaatgtgtgtacatctgtaattaataaaattagtacaattcacaacacatggtcgttcttaagcgacagagacatagaaatgtaacagcacattaaaatcctcttctagtggccccgagctgcaccccataaactctttgatagctcttaacaaatgcaaattaatgagcattaacccaggcattcgaaggtccagataaatcaccatgctcttcaggaattcatatgaacaattcacagtgctataatttttcctaagttaagactagactaatgttgagagagacagaaagagaaacaaaatataggtgcactctcctctgctcattatagggttctcttcgaccttgaggagactgctacttggggacatgtactgattcattttctgactccttttgtccttgattttgacatagccttggtgttgggaaattcttccctcaaagcctcaatcgctcatgctcaaatttaaacacatttccttttctgtaatcagtgagggaagagcagctggtcaccatcttctacacactaaacctttgagccttttcttcagaataaatgatcctacttcttagaatcataaaattagaaggggttttgatgtcagaccatcctttttctgcctttagacaagactacccttccctcttaccatcccatacagatgagcaaaaccatcctatttttaaaagagatcaagagaaactaatcaaaagcctccaacagtcacacattcctctgatgagcaacccttactttcaggaaatcatcatcattatcatcaaatagcattttcctaacacccacatgtgcaaaatatgtttgtgtattcagatcctaaagagggccctagaggcccagaaaaggttggaaaaagaaaaaaaaaaaacgtgcaaaggtacacaagcatcactaggctctttgcaagagagtctagttcattgcaataataaattatttttaaaagacattccagaaactccaggggattttcattttctatttaggaaagcgatcttataattaaagaatatatccattcattttcttttgtttaactattaggacttagtaatgactatcaaactcaagtctaatgaccaaagattgagaacataaatatgcagtgtattaaatctgaaacaaatccatactaaggttttaaaatttgcaacacgtataatactgaaccagttgtctctgttacaaagtgtgtatgtattgaggggaattgtctggaaaaatgtttaaagctctcttctctcccattctggctcctcctttatgctcctggagaacagagctcaaaggctgctctcaaatgttcaaaactccccacccatggctggaatggctctatgtccttcagtttcaccttccagtcaaggaattcccaatttctgagtattactgatttttgctaggttttaactaaataaagcaatttaattgaaggtaagccttcccttaatttataaatatttgataaagggaaaatttgccagtcgaacatgctgcttgatgcggtgggggggattttgacctgggtggcactccagtctggacttcaccttacctttaattgctctgccaggggatgcaacacagagtaaggtcccacgtcatccattcactccttcctctttttgggtttctcagctcctctccattgctcaccttcacgagaagttccctgtaaccgtgaaggttatcacaaggctcagagggtaggagctgacccagcacctgcagatcctgaagggcccctaatctaaatacaccattcaccccaacaggtgggaaacaatttgatacacaggctcaaaagtttgttttgattactgttgctgtgaagttttgatttggcctcctaaagtagaggagccaatttgatatttcattgcataattcctgtactatagtagtaggtactatctagcaagactttactgcaaacataaaatatattaatagaacatacaatggtattggcatacagctctttttattttttatcttttctaatagatatgtttattctatttcctaaacgtattcaagacttaaaattttcactaccaatgaataacatgcttaaatattttagggaaatggtaaaatggtaaacagctctattagtattattgaatatctcatatttgaaaggaaagaaagtgacacttgctgctttctcatacgctatcacatttaaacctaattacatttcaagacaagaatatttatcatctttttttctgttaaagaagttgagcctcctttacgataaactgaactcaaatgtaagcatctctaattctggagtgcatatgtgcacaattacataaataatttggtttaagaatcaacaaaactaaataaatgttaggtttctagaatttatccaaacatcatgatgattgactatttattgccgattttcctattgtaatatgcagaagtttcaattttaagatataatcgttatgttctccttatttgatctcgtatttccacagagctactctgtcattaagtgtacctaaattcttctccatagccttttaagattttccgatgtttatctgttctctgtatcagtctcgatcactgtcttcactctaaaagctgcacttaatagcttacttaccgaattagtaatttgggaattaccgtatagttacatggaaatattacttccctctgtgccacagactgggctttgattacttcgatttcaatgtcccagcagcatccagattttatgaataccatttccgatgctttgcttaaagttaggggccaggcctgagctcaagtctcaaggctgatgttgttaatatcaggacaggcgggttcaaaagcacaggcgccagctgccccacctccatggcacagccgtcatggagccagccacaggtctgtttcagattgcaaaggagggtctctgacttctgtttgcttttgtgctctaggaagacattgtaggcctccataaacaaaaataaaatgaaatcgaattacaacttctttttaacctatttaggatgtaaaggttaaatatatatgtatctatgaagaaatgcatgttaaaaagtggtttgaaataagacatgcggaagcaaaattcatttttctttgtatgggtaagtagtatgtttttctttgtatgggtaagtagtatggctaagtagtatgttttctttgtatgggtaagtagtatgacaatacgccataatcattgtccttatctattaactaaacctcaatgagaaagataaattattacattgcagagatatgagacttaagacttactcaaaaaattttaaaggctattccttaatgtaatacacttctatcaggaatagtacagaattttatctgagatatttgtattaatcaatatttttgattcatatgaatcattatttggatcagattttgatccaaataaatgtgaagtatattgaataattcagaattaattagtttccatttaatcagttcaatccttctgagttcatgattaggcaatttggaaaagactatataaaataatattctatttgaactatggaagtattcaaaagaaactggtaagttcatgagtataattgtccaagtgagctctgtaatctatgaatatataggaagttcttgtctttgagaatacatggtttaagtgaattctattatctatattgtcattttgattgtatttcaatttcgttatgtgtaaacggaagcaatggatgtactctttgaaaacagtttcacaaattaagaactttaaacaagcttttatcttctatttaggtcaatttgtctaagtatttgaggtaattttcatcctcatctttttatttgttatcttgtccaatcctattaatgagcataaatggctccccaagtgtaaatatttgaagggaaagattgggtcattgtaaattcaggtagcatccatagttgatgacagaatgacgggaagaaactttcctcactaaatgtcaatcaaattcatcagcatgatacttttacatgtctgcacagctggaaaaaacagtcaattctgtttcattgttatgtaaatttatgctgatactcaatgtaatcaacaaccgatgctagaaccatccttgaaacagattagatgattggattctttttaatataattctgaaactggaaccctaggtttttcttaggcacttcttaaatatttatggttatccagcataagtaacacagaaattctgtggtcagctagtataatctttttcaagcagtgtatgctattcttatacccacaccaacaaaattgtatctaaaacattggtatctaacctaggaaaaatctcaggtaaggttttacgattcagtgccttagtccccttaagtcatttcggccacagccttaaaaccctcctttaaagggatttaccatcacctcttgtaaaaactggatttgagcaagatgcattttattaatcaaatccataaggcagtcaatacattacttcttttggaatgaaaaaggaaaagagttatttcacaagcagatgaagactacatatgtaactctacttccctcggtaggctccaatacaggtttaatcctgaattttcccattttgaaaggcttgccaagtcagttctcagacctttcgtgaaacatgttgctcagaagtgacatcaaacgtgatcctaatttttgacagattcttctatacaatgacacatacctggccttcaaaatagagtaaactaaaactcactgaagaagaacaaaaaggtcactcttaccattcttgaggatttcgaaaatcaatgatcctacagaaggagaagaggccatttatcattatagcctttttgatgtcaaagaagaaaaagaaaaagaaacagaaaaacatgcctttaacatagcagctgatattagtagctttagaatttacaaagcactttactgttccgttatttcaattaacactcataatgttgttgttcagccagtcttaacatttgtgttataattatttcctttgaaagctgaggacaggagggtcaaataacttgtatcatttcccaaagtcttgcagctgataagtgatggttctaggagtctatctccgaaagattgagcatgaaatctgttttttttttccattccattgaagtgtgtatttactaactgggtatataattatgaattgaagactaacctttatttaaattagtgcaatcagactatatccagaatatttctagaaatgatttttaagtgattgatgagtaaaatgaagggtaaaatattttttgtttgttcacttaaatgcaaaccctctgagttaaaattttctcaataattatgtagttcaaacaatattttccaagattatttgaacttagatacaattactgaatttaggcatatatacattagggtttcttaatcttggcatcattggcttttaagtggaataattatttgttttaggaagctgtcctgtgcattgtgggatttggggcatcctgccctctacttaccagatgctaacagtactccaggttgtgacatcctcaaatatctttagaaattgccaaatcatacttaggtgagaatcaatggtctgtattaatttaactgcaaagacaagtgctgtttctaaatattacactggacaattctaaaggtttaccataaattagcagaggcattaatcttttaatgatagtattgtagtggatatactggtacaggacatagctatctaagctaattctatatatacagtagaccaaaactgacacattccaggcatcccttctaatcttcctttgactcctcttatctagagtgaaaattttcttagcttattttgcatcttcccagcatatcttcactgggagaaaattcgtctctcacatttttgcacatcttgcaagtcaggcactgaccacctttttgttctggattctcttttgaggatgtttatatagcaaacatccttggaaatgaagaatcatttctgcctgtgaaacagtgtgcaaacatacttactccccattatagaacattcaggttccctaagttcaggttcctcttcccctataaattcctttgccccttgtaaattattgttttacatgatcctctttgtgttgccatgtgggaacaaaatgttgatactctggatactgctgttactaaacttttcttgatctctgtcccaggagtcttctcattgcttcctactagaattcatgtatccatattaggatacattttttgttttgccagaaaggcaaaatccccagtccttctcattactatgtttttgttgtttgtttgtttgtttgtttttatgcagcctcggcgctctgtcactcaggttggagtgcaatctcagctcactgcaacttctgcctcctggattcaagccattcctctgcctcagcctcccaagtagctgggattacaggcgtgcaccaccacgccaggctaatttttgtatttttagtagagatggggtttcaccatgttagacaggctggtctcgaactgctgaccttgaaaatctgtcctttgaaatgaatgacaaattacatgctatttatgccccaaaatgctaacttccacatatatcattttagtatatccttatagattatctcacatgaaatttctttttgcacccattgaaagattattcctgaggatgtcatccactctatcacttattgtttcctctttatataagcatattgtctttttaaaggaaagctgatttttacctaaacaacagtttcatttctttatagacatcacaaaagttgcgagttactgcatttgcatcctgcctatctcttttaggaaatgaaggcttccttttttaagccaacctctagcagctgcataatatcattgatagtaatgttgggtgttaaccttaccactgatttattacttttctacttttaaataattgggtatctgaggaaatggaaataagatatatattaaatataggtgtgtgtatatatatatatatatatattcaagtatgtatagtttcatgccaacctccatattctatatataaatatatattacatattatattatatatatgtatgcgccaacatcttaaaaagtttacatagaaagacatcttggaataaattgctattattagtggagtggggggaagaatcacatgagcaatctaggtagcaatatatctaccctacatgaagaagatcacatgatctttggtgtttctcattgagtatccgggttagtagataacttattgacacagggatcccagagatcctcagggaggaaagtgattgtgaccccaacacaaagcttgggaaagtgatggaatggactagagtggcacttgacaaactattctgagagtagcactccaggagcatttggagaattcacaaggatggtaacattaataacaagggtggcttgatactagttttcaacacaagctctggccgtcctaagaaaaggctttttctggccaaaagtgttgcttactctggaaatccctaagcactggccattcttgcatgaagtctttcttcgggaaaacatgcgtaaatgattgaatataaattcaaagaattttaattgttgagcccaagtatagagtgacttcactcttctctggggactgaagtggaaagaccaagtgtccttcaggatgcgtggactccatattccacaacattgtgtggcagcatcagaagccactgccccagtcggtgaaaaccaccctctccaccttctccactctatctttctataaacaggatgactgattcccatacactgaattgaccctggaattcatggacattgtggtttttgtttgtttttgttcggttggttgtttagttgattgagagaagtgaggggaaatgataatatcagatggggagaataaattgattaaaatttcttaaaaggggccgggtatggtggctcacacctgtaatcccagcactttgggaggccgaggtgggtggatcacctgagatcagaagttcaagaccagcctggctaacatagtgaaacccagtctctactaaaaatacaaaaaactagcagggcatggtggcgggtgcctgtaatcccagctgctcgggaggctgaggcaagagaattgcttgaacctgggaagcagaggttgcagtgagctgaggtcacgccattgcactccagcctgggcaacaagagtgaaactccatcacacacacacacacacacacacacacacaaaattaattaaaaggtaataaaagaagcacgatcatgcagagcgttatgctggctacttttacatttttacttttacattactcatctatgtttcattattttatgtgagtttttagatctacttaggcatttgtaggtcaggtttgtttaatagttaaattcatctacaatcaatcttactttatgcatatatgtatttatagatacttagaatgacattaaagattttggtagctaaatctggccagtacaaaaaatatatattatctctagcctaaaatggaatgttgtcatttatgagttcattgttacctgactgtggtatctgactaaaaaaaattatcatagtatagattgctattttttagaatgaattattttaaggaagcacttccatggaccataatctcagagttggacaagagttctaaaacacaatgtagaaaaattgtcaatattgtcagttattaatgatttccagtgatataacacaactaaataaagtaaaataaaaaaatgatcccatttaactggtacttctaggaaattcaggtaggtgtctgaggtcactgaagaaactgggtcggttaccatatggtgtaatctaatctctttcaattctgtaagtctgaaatatatggtattttcaatgctttttttttttgagtattacattaagtcaggaaacagtctcttggcttgacgtttgagaggcagtgcaaaaagccttctactttcagtgctatggcattgctgatcacaatatatctatgacattctgatacaagatctgagaaataaacagaaaaagggtcagtcatttcagagaggtgattccattataaaggtgggtatgtgtagcattttcttgagaaacttttaagtttttctttgatttttctctaagttttaagagccctaagctgataaatacttaatgaattttcagtaatagtagacaacttccattagtattaaataacctttgtgaatcaacttgtataaatcacaacacaaatagtgaaaacaaaacaaagcaacaaaaaacgctaaactaaactacaaagaagtcttgagtgtttggatctgacccaaagtgaccattaaagttgtaaattttctcattaaattgataacaatgtaagccattctctacatcaattgaaatgccaacgtacttctgagtaataacatcccttccatgtggtctctgatattttgattctagctttttacgagcatgagtatattctttattttgaaggctgtgttgatagatggctctgaattggagggctaccaaaatctaaagggattctttgctgcttgtcatggttacagtcctttttctcttcagtagcttttgcttatctaaaatgatgaactttctcagtagatgtgcaattcaatcgagtcatcttttcccagatacaggaatggttattaatattctgccctctcagttctctatgataccctttatgaccattcagacacaggcattcatacctcactgaggacagcagggacaggatatgctgctgtgataacaactgaaccaatgacttggcttcatgctctctaagagctgccaactccagtgcgcccaataacttccaccccttcactacttggtccagtggtcagatggtgggtggatggggcactgcaaggcactgctttctgctgttctgctctaactcctgaccagatttcacaaacagcgtgtgctagctttaccatccacaaatgcagagaacttttgggggaatactttgcacagccctcaaccagttctttcctaaaatgtatgtgaagtcaccaaacacattgaaggttctcagtagattttcttccttctgtctttcagtttggttacctcgcctctttgttttcattgctttcagattctttatttatagaagggaaaggggaaaagctgtataccacagccaaaatttcaattttgaaaaaattccaatctacagaaaagtttcaaatttatagaaacaaaagtataataaatactagtaaatacctttcaattaaattcaccagttacaaattttgccacatttgcttttttctccctcattatctctatatctatccatctatctacctggctacatctctgtgtctgtctttgtgtctgtatattacacatacacacacagatgtgttaccttttctatccttttctatgtttactctagaaatcatgacaatatagatcatgtataagaaaatcagtaataagttaatattatccaatacatagatttacttatactgtaatttgtggtttcaccgtagtttgctttgctttgttttgtttctgatctctatattctctttcatggaaagagaatgtttatctgtgtggtgacttggtttattttggtttccgtaactgaatttctgaagaatccagaggagttatcattagaatgttctgcattctgaatttgtctcattgtttccttctgtttagcagcaagtaaaacatttcttctgttaagcagcaagtaaaacatagcaagaatactatgtaggtgatattgtgcacttaaagcatttgaacaggaggcacataattttatgttgctccattactgatgatgctggtttaatgacttggttatgatggtgactgccaggtgactccattatgaaggtgggtatgtgtgtgtatatatatatgatgtaagagtgtgtatacatatatatatgtgtgtgtgtatatatgtgtgtatatatatgtgtgtgacacacgtatatttatacagtaaatatatacatatgtatatgtatcacacaacattatatttatacggtaaatatatatatgtatatgatacatgataagtgaagaattgtggccttgtggcaatgtgagcatccttcttcctaaaaattttcatccagtagtttttatcatctaataattggtccttggtaaaaacagttattattatgtattgaaaaaaagatgatatttctaattttgtcatattcttcttattttttaactggcattctttgaaaattacctttctctttatatatatatatattttttttttcatgattctaagttatgtatttaaggtattttaaatattttaagcatcttgaaaaatttaaagtaggacatgttttataattactgtgatttcttatataaacatcacattttgataaaaataaagagtatattacataaactcattaaagtcttaaatttatacacttatctgtttcctttcaaagcaatttttgttaaaggtaggaaggagtaaaatccactgtgccttgggttttcattttctattccaactaagaagtgctgtccacagaaatgtatcattcagccactcagtcaaactttcctgagaacctgcctccatcaagggacttcgttagctgtaaagtgctgactaaacttgtgtttatacctccactcatgaaataggaaatatacacacacatacacacatatgcattcgtgtttatacctccactcatgaaataggaaatatccacacacatacacacataggcattcgtgtttatacctccactcatgaaataggaaatacaaacacacacacatacacacatacgcattcgtatttatacctccactcatgaaataggaaatatccacacacatacacacatatgcattcgtgtttatacctccactcatgaaataggaaatacacacacacacacacacatacacacatatgcatttgtgtttatacctccactgatgaaataggaaatatagacacacacatacacacatacgcattcgtgtttatacatccacttatgaagtaggaaatacatacacacacacacatacacacatacgcattcgtgtttatatctccactcatgaaataggaaatatacacacacacatacacacatacatttgtgtttttacctccactcatgaaataggaaatacacacacacacccatttgtgtttatacctccactaatgatataggaaatacacacacacacatacatatgcaaccatgtttatacctccactcatgaaataggaaatacacacacacacacatacatttgtgtttttacctccactcatgaaatagaatatgtgcatataatatatattatgtaaataaaattatatatatttatataatatacaattttctaatatgggctgcaggccaatatacatagatttctcctggctgcaggtgaccatgtcacttgcattgattataatatattttaattcatggaatttaaataaagttttaacatcagagactttcacagagattcagataacttgagatagtacataatatgtttaaaaagctaatttttttctgtgaatattgcttgtttccatagacgtttcattctacaaaggttcaaaatataattttaactaacaaactatgaaggtaattgtacccattctgcagtctgttagcagcttttgattagattctcatagcagaattttcccatatacagttgctaatatagaagaaaaatatcatctccttattggattatattgttaacttgcttttgcttaatattttggcatcttttggtaaatttctggaatgaataacaataatttacgcagaataatctaataaaggatatttatagcctatgtgaaaataaagatacgcattttagggacttttgcagagatacaaacacttgttctgtaaaatatttgttaaacgtagcacatagggaaagcacagatcctggagtgaaaaacctacagcttgaattccactccagcatttattagaccagtgacttggtcaagttgcttagtttctctgaacatcaatttacttgtccataaagagagagtggtggtacataatagatattttgacaggctgttaaaagctagagatgaagcgtgtcgggagtctgatgcatagtacttctattaggcaaggtttttcagaggaaaaagaaccaataggatgtgtatgtatacatatgtacacacacacacacacacacacacacacatatgaatgagagacatttaatttaaggaactgggtcatgtgatcatggggctggcaaatctgaaatattcaggacaggcaggcaggtctgaagacaagggaggttttaacactgcgcttccagtccaaaggcagtctggaggcagaattccttcttcctcagggaacctcagtctttttctcttaaggctttcaactgattagataagtcacgcacattataaaggacaacctgctttaatgagtctactgatttcgatgtggatctcatctgaaaaataccttcgcagaaacacttagtctgaggtttaaccacatttctgggtgctacagataaaattagctatcacagaacgtctacacagaaaggtactgacatttgttaaaaccatagaattctatttacatgaccaaccagaatgtgtctagagggctccagtgcccctgcagattttctatttgtgctggcagtttcttggatagcgtctcctattggctgctcttactttctgtctttccattgtttctttgaggtttcataggaacagtcctgttttagttaaaagtgccgctggctcccagggtcccaaagccaatgagtagataatgaatggcaagcaatacctgatcccatacagaagagggaaaacccttctctcccacacctgtgccttaaggtagcactgtttatttaacagacttgcaaaaatctaccatgaaaacagtgacttcaacttctaatttagcttttctcccaattcatgctcaaaccaattcctcaaattgagaagcaaggacgagaaatgcttcatcagttaccttcattacagtcgtatctctcgaggtgcactaaattcctttgtcttcaactgattctctcctctcccaacaggagatcaatgtacagaggaatagttcctttaaatccaggagtgcatgcaactaagcaactttagagatgaatggttgcatattccccggagccaattctagttgagctcaaatgatatattcttaaaaatagtaattctatttattttacaagtgctatgtaaacagagaggtaagtaccagcattataattcactaaaaagacctgattttgctgcacaaacataactaaatggctacaccctttaattgcagaatccagatttcctccaaactttatctcattccagtcaggaaaacagctatcgtctttttttttttcatcaaatgcttttattatcatgtttgaagcttttgattaagttggcatcgtaagaaaccctttcctattttctttcatgtttttcttgacaagcctgagtccgtcattctggctggtattacaggttcatgtttttgggtacattcatttatcatggagtgagtcactttgctgtttttgtttccactgtattctgaaaagcacccacagaaacatgacaagaatgcaggcttgcatggaagaaattctcatgccgggtctgctctgtctccccagtcagtctatcctgcataacgtcgtctttaaacaatagaaagcaatggctaaggataaaagaatgggttcagataaaactgaattttctaccaccctgaatattcactccatatttaatctgaagccaaatattttaacataaatgtatctttattgtctttgtcctggtcttccaatagggragtttttgtacgtggtacctctttgtttttttgtttgttggcttctactattttcttaattttaaattctaagcctccaggtgtcttgcttataaaaacgattctggattttctacttttaaaatatggtttcttaaccatttgcagttttgctaagaggaaaggagaatctataaagtatgtttacatgaaaggaaaatctctgtataacattctatcaaaactgtaataaagtgaaaattaattattaatattgatatgatttggctgttccctccaaatctcatgttgagatgtgatccccagtgttggaggtggagtctgctgagaggtgttcgggtcattgggatggatccctcatggcttggtgctgtccttccccactctctcttgctcctgctctggctgtatgacgtgcctgctcccctttcgccttctgccatgagcaaaagctccctgaagcttcccgagaagctgagcagatgctggtgccatgcttgtacagtctgcagaactgtgagccaattaaacctctttcctttataaactactcagtcttaggtactgcttggtagcaatgcaacaacagcctaatacaagtatacataatggaaagtgagccatgccatttgttcctttgaatatatttggacaattaaaccaacaataaaaaaaagaaattatatgcagtttctgactcgggttccttgaacttaagtggtagcagaagattcccctatctggaagagagaaagtcttcctaggaaaatgcaggagctgtttcaagtgtgtaatggagcagcattcttctgaaacacatttttgcttggaagcctaacatataaataaaaatatgaagagggagcttttctatttaaggtgtgagaagagggtgtcgggtgcccggttctacctcgttaagctcctttcaaatgctgagatgccatcgacccctgattctgtctcccaggaactcagactcaaaactcttgcaccagaaacaactagatggagaaaactacctgacaaaagtcctggacgatggccttgaaatcaattccttcatgtctttagagggtctctgtagtttttccataggtgcttaccagccacattcttggaggcgagctggctaaagtaaaattctgaactgaactgagcttgatagagttctgtgctcatattcccagcacagtctccatgttgggagggaaaattgctttttctcccattgcagtaaaaaaaaaaaaaaaaagtcaatgatcaagtctagattccttacaacttctgttagtttcctgcactccatggataatcaaattcctcgcaacaaaacagatgagctgtccctcaaaattgttgacttgtgccttattaggttggtagaagtgagaatgtggtattttaaattctcaagactgacttcgtgtatccatagagaataatgtattttatcctattttcttaactctgtatgtatttgaataagggcgatttaaaagttctctcacatcagtagaaataactgagctagagtttgcttgttgacaatgtataggcacaatatatcattagaagagtgataatgacttttattttggtgaaataataaaaaaggaatcataaaaatagagctgtctaataatgaaccatgtgtttaaaaaagaaaagttaactttctcatcactggaaataaggaatgagccagtggccatggatcacagatataattgtaaagattcctatattgagtgggaacacagacaaaataacccccaaagtctttgctaaatctatggtcatataaaagaaatacagctggattgcctatcaaaaagatccagggcagtggatactaactttctttacttgcagccaaagttttgaaatcttagtagagcgttttgctttaaatttaatttattaaccctgattactgcagtcagcaaattaaactcaagcctgtattatgaaatattatgaaataaacactttagaactgtcatctgtattaagcagctgtaaaaaagcagtgtcaagccttgatgatttcatataaaattgaaataattttgaatattcctcatggtgatttgtatgttttgttatgcagacacagaataaaaacaagtgaaccaaaaaaaaatgttatttaaaaatacttaagaaaaaaaacaatttggaaaaaaatctcgatatcggcactaatttaactttgtaaattttccaatgtagttcatgttcagtatattagcataatattgattgtattagaggggctcagtatttcttacggacttaagtatgtttaagtaagagcatatccattttgattaatgaggtctatataccttctctcttgattactctccagttttggggaaatcactttggtagctgcattagctcttttaggtcacctgaaaacttcttaataaactaagtggtacactagtaaacaaaaagaactcacgcggcttcccttgaaacgaatacatcactgggaattctgagaaaccaattaaaacagaattattgttttgaatgaatcatcagagaattctagtctaaactcttctaaaaacctacatttctttctaattttattacattaaatttaaagatttttttcaaactttttgaatgagaatagtcatcagattattttaaaagattaggctaaaatatgcaaaattcccttcagtaatacatttttttaactggaattataattagtcataaggggaaagtcattttagtgggaaataaaattcaaaaaagctaaacattaactgctgaagttgctttttgccctttgcaaattctttcttcattatatcattctctctatatttttgaatgcatatatttccaaagaaattactttttgcttaatataaaattttaggcaattagatgcaaaagtgtagtaaagcaacactaaagttgccaatttaaacatagggaagcaaaacagcccaggagttaaagttctgacagctatcttaactagcacacatggccagtgccactcagtacacagacacacacccattttcacagtcactgaggagctctaagagttgattttgaaacgtagtggaaattaccttttttgggaaaataacataaatctgagataaattcttgactgtccgtactcaaaatatttttttccaaaatgaaaaaaatgcaaatgtcctcagcataataatctaggataagtagttaatgatgctacattaaggcattacttggggcttgcaaattcatgactgacatttgatgatatcccaggttagaagagttatttcctttctttctttcctttcttccctccttccttccttcctttctttctctttctttctttttctttctttctttccttctttttttatttctaaaggaatgtgtaaattaataacaaaaacctttaacatataaacagattgataaattactgagcaaaccaaactgtccacccatgtttttccttgtggtagtctgctccaaccataccagcaaggcctagaaagagcaaaaaaaaaaaaaaatgtatatatttggcggtgtgatattttcttaaacaaagatttttattgtaatgcctaactatttctctcatttgaatctgagttgcaatttagacacaaatcctgaggtcagatcctggcttatagctggatactatagagcatgtgctgtgttcctgactcctcatctatgatgtagaaatgataaatcccacagcagaatgttcaagtgaaaaagaaataggaaaatataacgtatcatgcataaggcctcttataaaaaacacagattccaaaatgacatggtgattatcatcattttattatagccaataaattgccagggattttaaaaactatcattctctaagaattctatttaagaacatacatatagataaaatatgcattcaagattttgtaacaggatctggaaataaagtcaacacaaaacttttctatcctgctgctggtattcaattttctattcttgaacagatattaattgtccacattccctactttctctctcaagtttacttaaaaaaatatctactgggattatctacatggtgccagacacccgtgaaggatagggtagtggagaaaataaacatgctcccgtttctatggtgtttatcatataatggaggacattcttggcttgtgcatttatttggttcagctatgtaagggatggtaaagggaatatgttcattacagaaacatattcttactttctctcctaattacagtaaatgttcagaggtatgggaatggtcaaacagaaaatggaaaattataataaaaaataagaaagttatccaagtccacagtaaaactatacaattttataacacagaccaagaaaatattcgcatagaatttggtatgctttccttgccccatcaaatccaccattttagtgctctatattctctttctgtttttaacatatgtaacggcggggctttctgagctggcttccttggagtgcagacattagtaatacagacaacttctattcctcttccccctacacattgcttgtaaatcagttattatttatttatatgtttttaattttttgaattatgacagagaaggagtagatgaatttaggtagaaagataggaaggaattgctgagccaaaactgaacaaagaaactggtcttgccatggggttagtctccaactcagaataaattgaatttttatatagagtgacttgtcagatcaggaggatagaaattaaagctagaagccctcaaaagttggagaatataatagaagattatacccaaattaagcagaaattcaggatctcctttcaggtatgtttgaatcaaaagcaaaccagggatttgcaacacaagatacacattgccttgggacgttcagctaccctcaaaccatgaattttgcttaagggtctcaggttggtaatatcactaacctgagtgtgacagagacaagtcaatcaatctctggaataaggcaatttcatcataggcttcagcttattcaaatcagttttcaaacatgatgggcagcatatactacaggttcaccaagcataggcagtgatttatctgtgaatgggaataaacagaaataacccattaagtttacagatattgaaatttgtagacacagtctacaaaaatactatgtttttagggaaaatggtaagtatataaactcaaacaagggactatgtattaggttatctaaaatatttaaaacagatcaaaggaaacttctataaataaaatctaaaaacctgaaaccataaagcctatgggtgaaattaacagtacattagaaggagatgaagatagaatgagcgagttagaagaaactcaaagaaattatacagaataaaacagaggaattaagagacaaggaggacagaatgaatggttaggctttatattgaatcagagtccttgaaaaaaaagaaaaaaggatgggttgaaataatgtttgaagaaatagtgcctgagaatattccagagctgaggaaagacacctgcactcagattcaatgattggaacaatttttcagtagtataaatacaaagaaatgttggtgattgtaaaactgcaaaacaccaaaatcaactgaaaatttttaatgtaaccttgaaaagaaagagaacataagaaattagcatgataggagaaatatttaaatcagtaattgatttctcatcaacagcaacgtaagatgaaagagaatgaaataacttcacaagctgaaacataataactgaatctaatgcttgaatttctttcacaattatattgtctaataatccaacaatcacattagaaattaaataggagcaagaatacttactgcagccttatttgtattgctaaaagcatagaaatagcatccaggtcaataagtaggcatttcgataataattatgagatagcagttcattgaaatgttgggcatccattagaaaggaaaaggcaattcttaaaaatccacgtggagttgtattccagatgtaatttttgcaagtgcatagccatttgcatacagaaaatgtatgtgtatgtgccgacacatgtatagattttgtggtaatctctggagagatactcaagaaaataattgtcgttgtggagagaaatgaggtgctgaagaaaagcagccaaggttggggggattcatactttttctaccccttgtaccttttaaatcttgtttcgcatgtactattattcatgaattacatatattttttaaggttggtttgattttagtttttaattaaaaacaactaaaatacaaatatctccacagttatcaacagcacagattaaggaatagtgttgtgaagtgtcttcattttaggggtgattgtgttaaagttctggggacttaaatgacctttttcataccatccaaataccgattgagaatgtaaatccaaatctctctacaaaatccatccttttatttttactgtttaatacctccacatattttttaaacagttctatacatttggtactatataagttgtattgccatcaaatgaatattcatgttcactccaacattcatacgtgtttttcaacctatggggtcctgggtagatgattaggtcatgagggcagagtcctcatgaatgaggtgagtgccctcatataggagaccccagaacactcccttgctgcgtccttccaccatgtgaaggcccagcaagaggaaggccatctatgaaccaggaagtgatccctctcctctccagacaccaagtgaccctgcaccttgatcttgggcctcgtaacttccagaatcttgaatgtatatctgtttataagccaaccagtctctggtattccattatagcggcccatacataccaaaagctgtggcactaacaaaatccagcaaagaagagttggatctaattgtttcattaaaatttgattatgaatctttgctacggcctaaacagcagagaccagagttctctccttccactgtgcgagcttacaaattggccgctaagagacaacaaatctaccagcaccttgatcttggaattcccagcctccagagctgtaagcaataaatttctgttgtttatcagccacccaatttatgctttttcattagaatggcccaaaacaagtaagaaaatcccccaaaacaaatcaagtgactggtacatgcctataggctcagtaatatttttttgaatgaataagtgaataaaggtagagtgaatgtgtattgcctttgaatgtaaacctttaataccaattgcagtatgatactgaattcacttaagaattatttttacatagttgtgtagaagcaatttataatatggaaatatttctcaaatttacagaaatttgataaatattatatttattttatgtaaattcccaaactaaaaagacatgtcttttctctcactgtccatgtaagttagtggaagacatcgatctcaaattacaatatttaactgtattaaattgtatatatagatgcagactctaggataaaagattaaatgtttgatatttttaagccagatcctattattaaaatcatcaatgatttttactgtgaaggtgtagccacatgacattaccttcagaaaacttcaaagcagcaaaagcatgtcgcagagccaaatgcagttcccagtgccaagaaaatagctaatatacatgggcatggttccaaaaaaacccatatggcaatgtgagttgaacatcttttacagcagcaattccattctaacccaagttctttcccttaaatagcacctcttttatttcctgtagtcaaactggctgtacagtcctcactcttgccaaagtccttgtctgggatgtgcatctccaggaaccgaagtgctaaacctttctttttactagcctgctctgccaaaatccatcttgacacaccttaaattatattagatcaaaggctgaaaattatatgccatcaaaagcagaaagataaaatgtttatctaccgcattagggatgtgcaatgtttttaaagcacttgatgtttgagtgagacattattcgacgtctctgcagtgcagcatggcttacttccttggagtagttgatagatatattgtaacaggctggtggcaaatatgaagtggcatattcagtatgtgtttaggatgtttatgtgttctctgattcttgtggtgctctgtctaattggaaataaggtttacgtggtgagagcagtgaagcaacgacagggcaatactataaaagcgactcctgccaccagcactccatttcttttaatggatttctacatatttggaaacttttctaatttctccttaaaaaataaacccataaatgtcaagaagaatgtttttcttcctaatggagtttgcttgccaagctggctttgttgcaatgtctgtaggtgggctacggtaaagaccagtggaattgaagtaatttttaaaggaatattgtctcaaatgaaatataaacaaggaactgtgtacccaggcttcaaagtgataaacagatgatgctataatcaagtaatttttaataaatatttgatggaatttactgaagtccatatttcagtaatccatcatccactcccagatatacattgagattacaaaattaacaatttgtgctgttgccagaattaaaatttcctagtaaagttgaactattatataaccttagtatttttgcatccttaattttttccagattattttgcaggctataaacatgttaacctttaggactattttatgtccaggtactacttaaaaatgtattttagatacaacaatcatacaatattttctaccgttatggtttcacagtagataactaaaattatatatatatatatattttttgagacaaattctcatgctgtcacccaggctggagtgcagtggtatgatctcggctcactgcaacctccacctccctggttcaagcgattctccttgattctcctgcctcagcctccagactagttaggattacaggcacctgccaccatgcctggctaactttcgtatttttaataaagacagggtttcgccatgttggccaggctttaacataattgattatgtttcaaaaaataagaagcaatttctgcatacaaatttcagaaaaattcacttggaaataagttttattagcttacactgtgggtagagaaaagtaaaacattgaaaaggtaactgtttgctttaacatttacctgtaaaaacattcatgaatttacctacaatttcttggaagtagaaatatattctcaatgttgttttagaagcacatatttaatggagaaatttgttttttatagtgttatttttaaacataatttttaatttagaaaattatgacaaaaactcgttcattcccttttttggaaaaacgatacttaaccactagtaaatgttaagtcctgcattatgcacaggggttaataaaatttaggatgacatggctcaggcttgtttaagacaaatagcactgataggctgttccataaaacttgttatattgcttggaagaaatgaggcccatatataattgaatatatcaaagttagtaaaaagacaaccaccacgtgtttatccagcccctgcaatatagtgcattctgtgctacactgtgaagatcgctaaccattatgaagattcttacagtcatgggatgacaagacttctgtaatgcaatgattacagcactgtgtgatgaatgctctggcctgtgtggataaaatgctttagaaacatgagagatacctgcaaaaggtagctagtaaaagcttcagagaagataggacttctgaatttgggtcttaacattctaaaaaaagaaatagtttgaccaaagacatggaaatttatttgaatttgacatattttgtttgcttgtttgtttgtttgacagagatagggtttctccatgttgctcaggttagtcttgaactcctgagcaatctgcctgtcttggcctcccaaagtgctgggattataggtgtgagccaccatgcatggtcttgaatttgacatattttgatatttgggtaaggggagaagattagtgcaatggtttgcacattggaccgctccaaacctcatgctaaaatttgatccccagtgttggaggtggggcctagtgggaggtgtttgggtcatgagggtggattcttcatgaatgacttggtcccaccctggccttaatgagtgaattctcacaatgtcagttcttggaagtgatggttgttaaaaagagcctggcacctcacccctctctcttgcattctctctgcacacatcagcttcccttcgccttccaccatcattgtaggtttcctgagatcctcaccagaggcagatgctggtatgcttcttgtacagcctgcagaactgtgagccaaataaacctctttcctttgtaaattacccaggctcatgtatttctttattgaaacataaatggactaaaacatttgatgtggttgaagtgtaagttttatggaagagattgccaaggatgtgtccaaatggggtggtgggtaaaagactttgaacgttttccaaatgtatgccaatacatctagactttacttttgagctagaggaagaacaggtgcagccaaaattaattggaaaagtgatagattgcattttgtttgagaaggataattctgctattaaaagagtagattgcaatagagagagtcaagaagacaccagtttcagtggtcattgtgaaagaggacttggtttcatggagctgggggaaagaggtcagagaccatgggcaggattttgtggtcaacttgacatcgggatgatgtacaaagaaaaggcaaagaggaacaatctgggcagtgatgtcagtcgaaatttgggcagatcgttttgatagaatggatcaaatggaatccaaataaagtaaaattctcaattatgagaattcaattaaataattttgctttaaaggaaactaagatttttaaatgccaaagataaaagctgaaagtcattataactttagtcttccctaaaagtgacttaagcaagaaaaaaaaacagtatatttttgaaactagttaacagggtatttggcttaatttaaatgatctctccagcagatattccttttgtggtccataaattttcagttgtttatttatttttggaccatacagtaaagggttggacagagataaaaatcagggaaaaggaaagtccagacacagaaaccgctgagtgggcagaagcactgtccgagatcaggggggcacaatgatggaagtgcagttaaggttgtttccacgctgtcctagatgtacagagccaagagggtgagtctctcaaagccacagttgagaaggaggtcacttgagtagcaggagagaaatgctggcaagagaactgggccacaaacacagtccaaagggagatcacggaagcccatgaggaaagtcaggaaggagttactgcaactcaatagctgctatcataaaaacaaccctgctgctacgtgggagctggtgtcttcctgtaaaatatactccacctaattatcctacagcaagatactgcatcagtgcattcccattgccttgtaagtccgccttgccttgtcttgccttgccaagggtgtgatccaaaactgagtgggctgatatgaattgggtggtgctttcaattccctacatagtttgcctcctgaaaacctcctttggtatttgggccacggtaatgcaaaggagccattcatccaggtaaattggagctggaggtaggggctgagcctcttctggggcctcrgggggcttcatcatgggtcctggcctgagtgcaaagatagcatctagtatcacagataacttctttttgatgcctagccatatttctgattttcttgtttattaagagtgagaactacatttcctactaggctaggtcttacttcgcagttcttaaaatgtgttaaacctatttgtggttctcctttgaattcttcccaagttctctccacgcctgggaagttgtggagctggtcctctagagatgctatgtctatgatgccaacccaattacaaaacacaagcaaaaacaaacagctacgctagactttccaaactctaaaacatcgaatctcctctttgaccctatcatgaaagtgagttacttaaattaaagagtaattgatttgctgttaaatacattatttgccaaataatttgactgtataatcccagtgtagttataattctgtgtggctaaccctgtgttgctctggaattctgtcctctgattttatgaattctaagatgctgatttaatttaattttttaaaatatcttccagtttacttgagtccaagtaggctgatccacagaatcatattcaaagaattccaatgagctgttgaggaggattttaagccctccactagcttcctggcatcagttggctttgagaaccaacctaagtatttcagagctgctagtgaaatgaatctttcttacagatattacagagggttacagaaagttcagtttctgactcaccctgattttgagaaactgtttcttagggtcattccctaaggttggaatcgctctctctctctctgttggttagtgccctgtaaacactgacaattttctttctcttcagttcttcattcttggtctagtgcttcagtttccaagtctacatgactatgctacagtgtaaggttatttagacgtacaatttcatgatttctttcttctgggattatttgcttgacttgtgattagcttgcctgatcacagacaatagtaactttttaaccattcttacatgatttcccttttccttaaatttgttgtttctgtattagaagcaggaaaaaagggccaacgtttagaatttgaaaagcagtgtttgaatgcacttgttacctggtaaaccagtcatttactgctatcttacaaatgaccacagcacatggtagacttaaagaacaattatttgcacatttctcaattttgtggatcagaaactggcagcactcagctgagagactcttctgttttacggggattcacagcgttcactcagagacagatagctggtgggcaggccggtgtcagggaccaaggatggcatcactcgtgtgtctggcccttgacagggatgctggaggtctgggctcacctgggaatggagatggcaacacctacatgtgacctttccagcatggcagtctcagagtggatatggcaacagctgcacatgacctctccagcatggcagtctcagagtggatatggcaacagctgcacatgacctctccggcatggcagtctcagantggagatggcaacacctacatgtgacctctccagcatggcagtctcagagtggatatggcaacacctacacacgacctctccggcatggcagtctcagagtggatatggcaacagctgcacatgacctctccggcatggcagtctcagagtggatatggcaacagctacacatgacctcaccagcatggcagtctcaggttactggtacttcttaggtctcagctgaggactccagtgcaggtgttgcaagacagcagacgtagcactgcttatgtgtatcctgaagtcccatgtgtatcctgaagtcccagaaagctgcttcaagtagattccagtggagaagggagtcaccaaggctggacagtcatttatccatggcaggactagcaaaaaaatctgcaccatctctcatcgcacacacgtgggtaaggtttggactggtatgatctttttccataatctcattttcgtgatttcttaactgagaatataatagtaaataccaatctcacagaattgttatgaggaatgcagaaacttaatcaaattacttaattgttattttcatttcttattaatttgttcccattgaaattaatgttatgtctggtctcattttaaattatttatctttctgaatttggatcccatcctcaagttttcaatgcttgactttttatgaattcttgtattatacctcaaatttaataaaatccttttaatcttgtcttcaccctagcactgtctatactgtcccctgggtggaagtttcccatcattctaattacttttatacacaaatttgacttctctctccagcccctgtgagaaacatgtcctttctgttacacagggagtaggtgaaggcctttggacttcctatttttcctatatgaaactctcttctttcagatatcagaattttcctctctctctttcattcagaactctgctagacaatcatcttaccaggaagatttttattcatcaccctgtgctaaataacattggtactatgctgggctgagctactatttttccttgaatcctgctgtaggcttttcttcagacacttaccatcaccaggcgtaatgtgaatgtgtttgttcattgcatgtcttctccacgtgaatggaaacttcatgacaagaatgtgttccagggctgggcgccgcggctcacgtctggaatcccagcacattgggaggccgaggcgggcggatcacaaggtcaggagctcaagaccagcctgaccaatgtagtgaaaccccgtctctactaaaaatacaaaaattagcctggcttctgtaatcccagctactcggaggctgaggcaggagaattgcttgaaccctagaggtggaggttgcagtgagccgagatcactcaagaaaaaaaaaaagaaaagaatgttttccttcacctctgaatccctagtgtataggggagagcctggaacagagtaggggttccataagccaatcaaataaatgactgaaaaagagttaagggacaaggtcaaacaaaaagagctaatttaactgctaaacgattattctatttaggccaattggtaacccatgactgcttgtaaaattcaatttcattgaatgggacatatttcaaacataaacataggtttttttaatgaatataactgaactgcagattgcaatcaagatgttccctccctttctcatttagatttctcatcttattagccatcactgaccctcctctagtggttaaatgcttagtttgggacattatctcagccataccctcagaatggttgattcagtggttcgttgcccatgtgtgctgtgatgtcaacaggctgttgaatgctgagggcaatctcatatttggctaatgatggttcttcagaaagcaacacccttcagattagttcagcagggttcaactttgtggtgaccacagttgggctgagcaggctgcatgtcaggcagagctgtcagtctgctccagccaagagtggagtgggcacttcttgggatttggataaggaaacatttgtctgagcagttttaccaccttaatatgggtttgattcttctatttgtatacagagtaagccaaattaaaaaatgaaaagaaaaaagaaccagttcatttaatcaagacatgctagtggttagtcatcttttataacaaccacatcgataattcacctttttcattttcaaattagtttttggttgttttgtagacagagagccttagccataaattaaaagtaatgataattagccacatgttcttcattatgttgagggctttgaacatttcttcacatagctattagacatgtcagccacatgtaggaaaaggaactatagaatttcgtaattttttttttttttggaaaaatgagcaacagaattttaaggcagaaacgtgaaatgcgagtgatggcaagtcccagtgaagtggagaatagcatgctttatgtgaatgtctgatatttgttttctcagtgcttttgatctcagaacacctaacaggactggggcagaagctttttgctgacttgttgcatcagtgctaaagatgaaaggaaacagtcttcatattcgccgtggtgttgattgccctataaataggaaactacccagttaaccttgcctgttgtcatacggagagttttattaaaaaataaacagtgcgtggcgggtagcagaatgtgggatttctgcttagatgcccgcaattctttcatatacttcattaaaatgtgcaggagaacttcagagccatgaataaaaatattgttatggaaactgaggcctgttatcatagcttcagtgatttgcaatgattatttaatgaatgagtttatgtttgaaaatatcccctgtgataatatgaatttatcgctcccccctacccctccgatttcttttattttgacacatatggaagatgctgttttgttttgacactcagaggagatgctctttttatcaaaaatcactgaacagtaatgagattttagtgaacaatcttaccagacttcccgaacataaagaaatctgatactgaggagtgcacagtgttctataataagtaatcttaggtgtgtgcatgcttttcagtggcagtattcatttttcacgagttttgtatttgatcttaccaggatttgatgtaagaagacttgggtagctcttgtgtagacacaaagaacagagaggacatccataaagccatagagacaggatcccaaccacagtgtgaggagaaactgatgactatgccaggcatacagcaccatctcttcagcctaagagcagggggtttaccaagctcaccaaaacaacttaccattcctctttccgcgtgattggaactcatcttcctcctcagagggtgcagagatgaatttagaaggaagtttgaagagcccatggtgtccagaactcaggcctgcttgcaaatgagtggctctgggactgtctttccacatctccaggagcctattttccgggaggaaaatgagagcactgttcagaagtactggaaggaacctgccaacattgagtttcttgagagtctctgaagttagttcttctaatttttagtaccctgacaatttcatgcaagttagtaacttttgcatacttcagttttctcatctgtaaaattggggtaatgataatatctaccaccctcacagacacacccaggattaatactttgcatccttcaatccaatcaagttgatactcagtattaactatcacatggtccctgaaaattttattttattctgatttgggaataaaaaagctttctctttgaccccgaaagtttttctctttttgttaaaatatattaaaatatttatatggatttctaaaatattgtgagccccaggaactctggttaatgtgcctgatgatctctgttgccgtcagggttggtttctcattagggcacttctgggcttgtagagggccactttctcaccgtgtcccagaatggaccttccaagatctctggtctcctttcctcttaaaaggacaccagtcctatcagattagagtccctctcttatgacttcatttagccttaattatcgccttaaaggccctatctccaattgcctttggggctaggaaatcaacatatgaatcttagagggacacaattaactcaataacagtgacattttaaaaactacaaaataagggaaatatcatagtttttttctttactttcacatagatattacatcatattaaaagatagatcatttcttcattttaattgaaaccagaattatattggaataaggggtgaccaatatgggtttttcaacatttactcttatattaatgtattagcagaagacaagagttcgatatttcttaataattttcctagaaattgactaatatttttatttttactttctcagatatattcgttttaataaactatttttgttgttatctaatagtattcaatttagacaatttggagaacatggatgcctataaacatacataagaatacaaatgtatcctgctttcagcatcagagataatttagggttattgcaattgtttctgttttggcaaattggaaggattatggttgatgaactgaggtaagtattctaggaagaatatttgctgttgggtcaggcatgctttcagtttttatgtatgtagagtttgatagaccactgagacatttaaaagatgttcagaaggtattgaacttttggaaaggcagatcaaaatcccacaagggaagcctgacctgtgtacagacatttgtgaattgtctgcatataggtggtattgaagccatggatgaaattgctaactaaagcatactcttgtgagaaaagaagaggacaacttacccatcgggcacattaaccacagttcctggggctcacaatattttagaaatccatataaatattttaatatattttaacaaaaagaaaaagaaaaactttcagggtcaaagagaaagcttttttattctcaaatcaaaataaaattaaattttcagaaaccatgtgatagttaatactgagtgtcaacttgattggattgaaggatgcaaagtattgatcctgactgtgtctgtgagggtgtagccaaaggagattgacattgagtcagtggactcagaaaggcagacccacccttaatctggctgggcaccatctaatcagctgtcagcatggccaggatattaagcaggcagaacaacgtgaaaagcctagactggcctagcctcccagcctacatctctctcatgctgaaggcttcctgccctcaaacatcggactccaagttcatcatctttgggacttggactggctctcctttctcctcaacttgcagatgccctattgtgggaccttgggatcgtgtgagttcatacttaaatacttaataaactcctatatacatatatatatatatatatatatacatatatatatatatatatatctaccatattcgttctgtcactctagagaactctaatacatacaataaaaatctattaaatttttgtctgaaacagaaaaaataaaatatttaacctttaaaaatgttcaatgttgatatcaatatgatgccagagcccaatgaaaacaaaagtacttagttcccacaaaagttataatgagaccctgatttgacctagtttggaaatagcaacctttaaaaggtttgagaaaaataaatacctacacaagtgtttgaaaatatcccaggtgtctaacaactcactttctctatgtctttcccataccccaaatatcaaccatgacatttttccgctgatctttcagatctcagaaggcgacatgaaggagatccctctgctgtgagattgctattttcctattgtacctcaattacatttataaacttctttctttcatgccagcctaagtggtttttgaatttattaactttaatgtttaataaaccagtttctatagcaacaatcctatgacagatgttttgttaaagtctctttaaagcacacacctctgtcaatatgttattttgaacatttcaaaggataaactcttgaaaaaggctgcacatatctcaactttcaagctcacaatttgcattaataattataccctctcttaataaaagaattatttaatagaaggctgatgagctaattttaagaataatacagtaaaaggtcaaaataaaacttaccactctcgagaagaaagtgtaaggtcaagaaataaaaaaaaattacaacatggactatactactttcctcaatgttaattactttaataaatgtgtgacgaatgattaccaacattttaaaatctatgtgcatttttctccaatgagtggcactggttttctttgcacttttagagtgctcagtcctggcatatgtaggtcactgaccgggaaattaccatctcaattcactttctttcttctttgctatttcttatctgatctcgaagttaaggcattgaaactattgcaaaaccctcattattttttcccaaattaaaatggtaatatttaatagctgcatattttgatgcatgcttttggctctggtttcctttttttatgtgtttttttttattgttgttgttatgaaggggttttttttattgcttttttgttaaagaacgtagcaaaaaaaatgaagtatactaaaagctatttcacccagagaaacataatttgttgggtttttaaaaatatcattttcatctgcttctttgggaaacatcagaaataggcactgagggatggcaaggtttatgctgaactctaagtaatgcatgttgtcacttgcagccagtcactgaactttctctgccgtagcttcctcatttttaatgtggactaagactccacttttatatcaccacgtccaagtttagacacgtgaccctaagttgctctatcagggatctctaggccttccctatgtgagacacaaggtgggtatggactgcagtcaaaggcaagtgaggtttttttttgtttttttgtttgtttgttcattttttgagatggagtctcgctctttcaccaaggctggagtacagtggcgtgatctcagctcactgcaaacttcgcctctgggttcaagtgattcccctgcctcggcttcctgagtagctgggattataggtgcatgacatcatgcactgctaatttttgtatttttagtagagacggggtttcaccatgttggtcaggctggtcttgaactcctgaccttgcgatccacccgccttggcctcccaaagtgctgggattacaggtgtgagtcaccgcgcccggctgcaagtgagtttttaatgaatgcatggacttgaggacagaagaggagcccgaggtttctagtgggggctatgcacagttctgtgggttaaaggttgttcttcctctttccctgagctggggagctagggcaagctatgtcttatgtctcccaagagtcaaaacctttggctccttctaaataccagcctagctcatactaacactggatgaatacatttccacaacagaaactcaaaatccatctgtttaaggatgcatgacaaatttcatttagaacaacagtatgagagtcatattcaaatgtgaagcaagagtgagcacaaggctcttatttgttccttaagaaaaaaaaatttatttcttagtgagtttaaatcatcaaccatgcttcaggaagaaaaatgtagcctggcctcctttccatctctttgtgattgtggaaaagtggacctttaagatttcactgaaagattacagacctgctcattaattttacattccaaacctttgactggtgataaaatgaacaaaagaatttaaaataaaggtggaaaaaaatggatcccttttcatccgtgagggccctcaggctatatacaaacacaatacacaaaacctgcatcatttacctgggacaatgttatgggctactaagtcgatccttttagaagagcagtgagttaatggattgttttcctgacaatatttgtagtacagtaaaaaataaaatggggaaaatatttttatctggcttttaaatgttatgttttatggttgggttaatgttgtggctgatcagctgttacatggtgcatgaatattgactggattctccattagggctgatggggcatcaccgaccagctatgtgatctatgttctcccactggctcttgcttggcatgagagatacatttgcaggatgaggagcaggaatgagagctatcgattgtagaaacagaatatagtagagctgattgacctgtttcaaaattaagaaatctgttgccatatcttgcattacactcttttattttatattcttactctgaattccttcatgaaatgcacaaactccaccctgtatatacatatatatatatgtttgcatttcctagcttttaaaaatagtttaaagtataccttctccaaaggggaaatactttgaaatatttttggaagagaaattgtattagtttagatccataataaataattatattgttttaaaagctggtgcaaagtaacattttcttatattgtagaactctaagccttttggcttagaaaatgagagcaatattcttctgcttttcatcacttacagggatattcttggtattattatataaattttattttcattaaatataccataaaattccaaatgtgtgtttcgaattactggcagaaaaatgttggtaattttttccagtgtgacttaactgtcattataattaagtaattgtctccaccaaaatgtttgtttaggcaatacatttctgcatatttgaaaacctaataaaaagttttattaaagctgttcactcaaaaatagacaactgtgccccgctgagcagtagtttaaaaccaaatcaatgaatttgctattatgtagacaagaaagtgtcctatcattgacattagtaatgtttccaccaagttgaacgtgatgagggagctgttagttgttaccctggaaactattcaaaaggtctagagctgctgaaaaacagaagactctgggctcacccctgggattccgctgcctttcagaccatctaggatccaaattttgggaatgtattctgtatgtctgaacatgctttactgccattttagactgattgtatctaattttaagtttatgatgccacctctctttttccctatatttctaaactttctggaagacgttctgaaatcattcaagtttattctcattttttatatctcaggactagtcactcaatctttaaataaccacttttgatcaagagattactgtacccttctgatacaacttaagatcataaaaacaagttgatccaattcaatagctttttcttatattataattcatgccctggccgaataattccaactttttctttttttgaaatatatgttaggttttcctggttctcaatcaatctacgtgagcactcattctttctgtattctggttcctactacatcttttatcagtgtctctttttgcattcattgatcagtatctctttttttaaatgcagaaaaaatagagtgtgcttataaatgtttaactattagccagctatttaacttcctaacactatctgatatgcttgttattaaatccaactcattttctatgcctttgattcgccttatacactactaaggacagaagagcaatggagtcgatctaaaaccagagaaccagaatcccttactcccacagagagattgcctgtgggctttaggcatcggtttacttgtctctagagctcaagttcacaagcaccagtagccccatgggtagaatgtgaacctctgttctatacagcatgttgatgaatgcattacttctgccttagtcatgtcggagcacagtaaatgtcaactagcagtgcagcaccggaacacgacatgcaatctgctcacctgagtcatgctgctttcagaagagaaggcactggtttaaatctgcatggcaagcctgcccgagctagaattcgatgagaaccctcaggttaatagctttgctctttgagagagctctaagctcttttcattccagaccaatttcacatttacatactacctgtcactaaagccccaaggtccttcgccaacaagaagcagatatttactcactaaagttaatgtcccagcgctttctagcctttggacacagtttttaggcaacaaggaaaataatacatatgtataaatggccatttgtgttcctaaaatagcaaggggctataacccaaagcctagaattctttttcgtttttttttttgttgttgttgttgtttgtttgttttgttttgttttgaaacagtcttactttgtggtccagactggagtgcaatggtgcaacctaggctcactgcaaactcagcctccctggttcaagtgattctcctgcctcaccctcctgggaacctgcaattacaggcgccagtcaccatgcccggccagtttttgtatttttagtagggatggggtttcaccctgtcgttcaagttggtctcgaactcctgacctcaggtgatccatcgtcttggcctcccaaagtgctaggattacaggtgtgagccaccacgcccggccctagaattctttttcttaaagacaattataatggtaattccgtttaaaatgtcactataaatctatttcatttattactgcatgattttaatctattattccacttaaaagaaaaacaaatcagagaaatcagcaagggggcaataacaaatgtgggttagggtacacagcccactttgggaccatattcaatgaagaataagatgagagaaagataatgtgatttcttttattattattattattattatactttaatttctgggatacgtgtgcagaatatgcaggtttgttacataggtatacacgtgccgtggtggtttgctgcacccatcatcctgtcatctacattaagtatttctcctaatgctatccttgccctagtcccccaccccccgacaggccccagtgtgtgatgttcccctccctgtgtccttgtgttctcattgttcaactcccacctgtgagtgagaacatgtggtgtttggttttctgttcctgtgttagtttgctgagaatgatggtttccaacccggatgaagcttgatttattaagaccaatagtaattacagagtgtgccgtccatgagtgagttaggatgttttctgtgacatgtgagagaaagcccaattcaatcttccttaagcataaaaagatactttattggcatgtatgagtaacagttcaggagtagatcctcaagagtggcttatctaaggcctcaaagatcataatcagagtctaatttaactcatattatatgtattgattaagcttcatctatgtaagctctatacttaagctccagttcctactcagaaagagggtgacacttcctgatggacataactgaaaccccagaatggggtcacaaaagccccgagttagactaacttgtgaaagagcccaccttagaaccaatcatgatgcccaaagacttggaaagtgctgattttgaagccccatcatcgaagcagtgaaaaggaggcccggcatgactggccccattttgctcctaagcccacctttaggtaaacggcttttgcttatctctgcatgtaggccaagctggctacgggtggaatttggtttatagtttcactttaaagcaaggtttgtaataattccttcccaaaactaaccacggaggaaacaagaagggcgtacacataattaagaacattaggttaaagattataagagcattgtgacctgaccaaggatgaagaacttcacagtccactccattggaccctcattgctgcccagatatatgtggtcattggttgcctcgtgatttcaactccttccctctttcctcttccccaaacttaaatgttcctaaaattctattaggatggttctttaggacactaatcttccatcttctcagtttgcttgtcctccaaaataaagtcagcttccttgctgcaacatcttgtctcttgacttatttgctgttgtgtggcaagcagtatgggctttgaactcagctacatgtctccaagtctgtgaaaatgatgtcctcttagagtccttctgttcacacctgtctccatctcccggggctggagatgtagtcagcttgacctatgcagaggagatggtgcgttccctcaagccatatgtgaatttcctgttgccataagaagattgatcctggggctaacaaaacatcaaagcctattatagataatatttaattaaatctatggatacttctagttccgttagcttccagccaattgtcaatgccacttcataaaaattaagacaggagcacatttttggagcacttagtatagactagatcttatgttaaattatttagactaggcagacatttatcatagcagttgtgtaagtaattataattgtgtcttcttagagctgaggaaacatataccaaaaaattttaagtaatattgacaaacccacatagccagtgagaggagaagcaggagcttagaaacaagcttgtctgactccagagactgcagctttgcttataaagacagaatagagaatgttgcttgaaaacataggttcaaatatatgtttcaccacttagtagccattcttctttgaattctccacctagatttgggatattttcttctatagctaatgcctaaacacttaaaagtattgttcttttaaggacaggcaccttcagagcctgtcagaagttgcgatcaaatttcttccttagtcctacaatttctattagcctctttttctatgtcagttactctggagtttacttaagtcaatcaaccttcacttcaaaacttcttccctggaatctttttccttttcctttcatttagcttagctcaaagtctatgcagtcttttttttcttttttttgagacggagtctcgctctgtcacccaggctggagtgcagtggcgcgatctcggctcactgcaagctccgcctccggggttcacgccgttctcctattctcctgcctcaacctcccgagaagctgggactacaggcgaccaccaccacgcctggctaattttttgtatttttagtagagacggggtttcaccttgttagccaggatggcctcgatcttctgaccttctgatccgcccgcctcagcctccctaagcaggggtgtctttatttatttatttatttgttcattttattttattgttttttgagaaagagtcttgctctgtcgcccaggctggagtgcagtggcgtgatctcagctcactgcaacctccacctcccaggttcaagcgattctcccacttcagcctcccgagtagctgggattacaggtgcccgccaccatgtctggctaatttttgtatttttagtagagatgacctttcatcatgctggacatgctggcctcacgacctcctgacctcaggtgatctgcccacctcggcctcccaaagtgctgggattacaggcgtgagccgctgcgtccggccaaagcagggatgtctttaatgccgcatcttcagtgcctaccatagagcccggcatgcaatagaagtgtgcgctaactcttccacttatccctgggttaggcccaactcctccagctatagtagtagagtcaaggagatcccagaaaaatctgttttctctgcacccaggcttttaagtcatcatgagcaagactctgccttttcttagtttttccaggtggtgaagatgtggaacaggaaaaaccacataaaaatgcaatcacatgaataaatattgcctacaatggctggattcaactgaagaacttacactctaaatcaggagcacagactcatgtttatgcctttgtcccaggcaccaacttctcttgaacttctttgctgaccctgcctgaaagtggagttaactaaatcttgtgtagatctgtctcatatcactatttagcccatttgcagataggtatgatattgttaaaatgatgaaaatgccccacgttggactcagttggatattctgctccggcagatcaggttctaactggaatcttggttcacttcacttttgtaggctaagatattctattcgtacttgactgagcattgtattgatgatccctgataatgcagctcttcaaatgtaataaatttcttttgtaattgactggccatgcccactcaagagatatatgtttgttgcctgattgagtgtctaagtaaagaattaaatgaataaatgaaagagtaacataagaaataaacaacactgggacaatgaactgagacttcatttattaagaagcaattattgataattttgtatatgattttagactataactaatatactccaaatgcaatagtagacaagatagaaatggtcccttccttcatactcgtggttgaaatacattgtattgctgatgttccatagcttttttacacatgttgttttcatttgtttcaactaacggtaaggagtgtggatatttgaatcggccagtgcaaaatgcagtgacttggaaagagggaatcactgttagtgaatcataaacaatatttgaaggtccttcagtggtttattaacttcaaataatataactagatgagtctcggttttacaagtaaccaggaagtaatgcaagaatcctagcgagggtggtatcaaaaacataaagtttatgtataaaaagcatttgaactcaagaatttgacatagaccttagtgaaaatgcagctatttcttgtcagtttaaaagaaataaataatttgttaaattcaaagcaagggatccctaatcaacttagctcacaggtaatttcaaataaacataatgcttattaacagttccaatatttgactttttgctcaacctaaattcagcaatgcaatgtgctgagatatatcccagtaaagagcagctgcttttgttttgttttattttgttttaatttatttcacaaacaagtttctgcatgagcctgaatctttacaatgtgaaagctgtttggattcaggtaggaaatacgtttgaactgatgcataccaaatttccaaaagttcacctttttatcttactgcttagctgttgaataacacaacttttgcttagtcaagccttctttcattttcttgaagatgaaaatgtaattcttgagttacttctgaagaacaggttggggaaatgcaaataagagcattactcttctagagtatgaaaagattaccaaatttaggttttctggtcagtaaaattatattttcctaacttgtttactaattacagagtcatttaattagattatcatttcttctttttccattgccatctttttaaatgatgatatttccagaactgctctatttaactgttcagtgaaattacattcatgaagctgacaattattcagaagtaagtttcctatgtaactctcccattcttcatattctttgtttctaatttatatttgggtctgaaaattgataaagttactagtttagaaataattaactgtgacttcttattttcagaaacataaatgagggtgcacttctccgcagaacctttttcacattcttttaacaaccaaatcattcccaattttctggtgtgtaaattccatgtgatcagtacaaataaacaaactgacaagatttgggcagttggaacccattgttttacaacgtctttgtttaaaatctttcataattcatcttcagcaatggccttcctagcaattagttacctttagtgtcttcattttcgtttaaatgttcaatgatcaggataattagaattaatttctcattgtcattttatggtaatgaagcttctgccacttatcacaagcatcctgcaggcacagtgttaccacacaaatatgtgactcctcactcttcacacactggtttatggtccctggttaaagtggtaacagtaggacctggcctgattccagtttaaatgtatgccatattagatgaaagattgtgggtagtcatgctggtattcttgccccttgtggatggcattctatgtgcaactcagttctccttaagcaacacaagagaattttcgtctccattagtctgggtgttttacagactgggattagttctacagttagaacaaaaggaaatatctttgtgaatgaagatggaaggcaatgtcaattcaaaactttataaaaacttcagatagaattcaggaaagcaaaggttgaaaaacttagtaccagaaaatctatgaagaagaaagtgagtcagtgaattctcaagctggaagagccttcttgcattatctggtctaggattctccagccacaaaaaaaaaaaaaaagtaattgtgtattatcatccccattcattccctgtcatatctctgcctaagcaattgcagtagaattcatcctatcatttgtatcctcttccttactcctgggaaacatttagatagggtaaaggatttggttgagcagaaacctggggtgggaaatagggagcatatctaggtttgtcaaagaaggtatttaaggctgccctgtgaaatcataccagtttcaaaattagaaacttgatcttttttacagctgacttttcttcaccacattttaaacttgttctttattctgcattttctcaagaagggatatgatattaccaagagaaatacttgctctcaataaccccaacctcattttcttatgagtttgggtaagttagaaagaaggtcaaacttagtagcttaaagaaaaaaacacattttcttttgcttataattgttgaggaaggaaattggaaagggctaggcagggcagaattggaagttttcctgtgtgtctggcagatgttggctagtgctgcaattatgtggagtctatttaaactggccatcctatggcttcttcatgtggctggtggtgaatggtggctgttggctgggaactcagccggggatgacaagtggatcacctccatgtgtctttgtagcacagcagtttcaggcttttagaatttcttccagtggctggcatatacctgaaagaatgtcccaagagagtctaaggcagaaatgtgtggcttatttataactagttttggaagttacaatgagacatttctgctgcagtttactgatcacaagagagttactaagattgatcgagtctctacccatgtgagggaggtgaatcaaagaacttgttggacaggttttagacctgtcatagagtgtaaaaaagctaagaggcttcatattcaagggaagaaatactttaaagttctccagggatgaggctagtagtgatgattcagggcaagaccagtgaagtaagagaggctgggacatgcattgaagaagctcactgagaaagttctctggtaatgggctgcaatgtgctggagttagtccacaatggcttgcaagatccagttactcacttgttttctcaattccagctctgagttcagtgatgtcattgatagtttgaaaatgactacagtggaatatttacaccacattaattggcagactctacaaataagggtgttttttccccaggagacccagttgctgaatagttaccaattggtaatggggcaacttagaaactacttttaggagaactggactgtctcatagcaattctatgttgtgaactttggggttaaaaccactctgcttttgtaaccttttcagtaaaatttgcgaggttccctattgcttttgggtgaatgacattttgggggataatctaatgtgattctgaatttgagtcaacactggctgtttcagaacagcacatgttgaagcaggagcctgatgcagaatacgtcattagagggaaagtgctggtaattagcagaaattacaggaagctctgtacttcaaagactttaaaattgagtgtgtgaaccaagcacatttgagtttccagagaaggaatgaagctccagttgacactttggttatacaactgcatgataatttatcatttacagtatacttttatgtacctcataatgtttaaatgggttatagatcaaatgcaaatatttaaatattttgcatgacattggacaagtcacttaaattttctgatactcagattcttcatctctaggaattagctgaaagtatctttatagagagttgtttcagtgagtgctgtaagattaaaaagaaaaataagagaccatcattagccatgagtttagtaaatatttcccagtggtggaacaccaattccaagtttatgtaagttggtgttgatgggaaataagcaatgattaaacaaaggaaaatcaggagaaagattgttaacaaagggcaatgctgtataagtgcaaaaaaaaaggggaaaaccacagttttttgatttcacaaggaagcagagggctggctttcattcatgccccactccagcctcagttccattgcttcttgccggcaaagctttctcgctctgacagaaggcaagcaaaccccaagaggccccaaggtggcctgtcagagggggtaaaatatatagttttgcaattgtataatattaatgttcttatcagagtgagaatgtgagtagaaagcagagattttaataatatgacccaaggaagtcaattttgaacattttacagtattaacaaaaatgtttagaactttagaatatatttaactcaataaaaaataaatatattttatgttatgtatgaataacataaacaaatgtttggattagttcagagttgatattttaaaataataaatgttttgttctagtccatttaattatgggtcttgattggcaattctggaaaggactcagaaagtaaaaaaggagagtagggaaagcctcaagcttagataccacctaagtcatcattaatagctattggtagaaatatgggtggtgaagaccattctgatgtgttcccagatcctactggggagaatgggattggaaaatggagaaaagtctatctttgttatgaagtgtcacataacttggctgagttgtgttcctgtcctgatattttggggaaggtagaacttgtgagtgatgaaattgtatatttggctgcagcactttctaaacaacactttgaaagagtagcctccttcctctttgctgctcctagtaaaatgggagaagagaaaaattattagaggatggaattgttaatcaaaaggaaagcaaaacttaaatatctggaaaattcttagtctatccatattgtaaaaaatgaggaagtatctttgcaagagaagaccaagggtgtgaccaaaggacaatctaacagaattactcagtcatttaacagaatctagaacctgttgtccnagaccatggaaggataatcctaaaagcaattcaaaaactatcagaactgccacccctatcgcagacccaaaatgcaaaagtcggggcagcagggtggtttccaatttaaagaagggaccaccacgaccccgtgctgcttcacattgtggatctacctcccttactctgttaccatgcaccttggtagccccagattcagttctggtgaactctggcagggaattgttaggggggcagagccaccacagtgaacttctaataggccaatgcccagcagagccacaagagtagggctgcccctgagacctcagacctggagagccacgggcataaaattcttggctggaagatccacaggcacacatctccaatccatgagagctgcattgtaagttgcatctggcaaagtcatgtagccaggggttcccagagccttggaggtccaaactctggggggcaaagctaagggagtaccacccagggtgctcagaagggacttttccccaaagtgggttggaagggcagagcatcaaaccgaagaagattgttattgagacttatgctataatgttttctctgttgggctgtggacttagggcctctttcccctttcctctttcctgtttctatgttttagaatggggatgcatgttctgtgcctgtcccatcattgtattttggaagcacataacttgtttgatttcataggttcacagctagggaacaatttgcctcaaaatgaatcttaccttgagtctcattcatacctaacttagatgatatttagatgagattttggactttgaactattgagttgatgttggaccaagttaagacttttggggctactgggatggaacgaatgtccttgcttgtgagaaagacatgaattttgagggctagggacagaatgctgtggtctgaatgttcatgtcccctcaaaatatgtataaaaatttgattttccaaagtgatagtattaagtggtggggcttttagaaggtgattatggtggagccctcatgaatgggattactgcacttacaaaagaagcccaaggaaaacccctttctccttccaacatgggaagatgtaggtgaaatatgacatgcttttctgtgaacctaggtaaggatccacaccagactccaaatttcctggtgccttgatcgcaaaccttttagcctccagaactataagaaataaatttctgtttttaatgaagctgtgcaatttatgatacttggttatagcagccagaagagtccaagacgtggtcctacaatgaagttagagaatttttttaagtgtctgtttattgttacaaatggcaaacaaaaggtcattatgcttacacacacaataaatgtgtacaatgtgtatgagtaagtttaaaacaacaattttttttaatatgaaagtcccagttagttttaaaagaaaatgaacaactgagagtaataaaacctttgttcttgttttgacagtgatggggaagggttttcaaaaataatgagttggcttcagtttggaattagggaattacctaccataaaactgtcttttagatatcctaaaatatcatctgttttgagatacacaacatctaaaggccaatgactttattttcctgcacagagaaaggagacctaagaaggattattttaggtttggattcagaaatggccattgtgtaaagtatgtgagagcagatttgaatatttgccatagtgcagaaataattgcttatagtacctgatttttttaagttattatttcatccataatatatctttttcttatatctttaaaatttttacaagataaaatgaaaattgaactaacttagacaaaggttattttcaaattataaaagtatatagatttcaaaatgtttattgaatacttatgcacaatggtcaaaacacttatatttttatataatacactatgatttttagcattctgagcaaatatgtgaaaccttttagatatttgcattattgttaacaaagaagttagtgaaacatgtcacatatatacagtttttttatattagcttgaatttcttaaaatcagcctttaccaggtatattagtccattctcactctgctaataaagacttacctgagactgggtaatttataaagaaaagaggtttaattgactcacagttcagcgtggcttgggaggcctcaggaaacttacatcatggtggaaggggaaacaaacacgtcgttcttcacatggcaacaggaaggagaagtgctgagcaaagaggggaaagccccttgtaataccatcagatcttatgagaactcatttgctatcatgaaaacagcagcatgagggtaaccagccccatgattcaattacttcccaccgggtccctcccacaacacatggggataataggaattacactcaagatgagatgtgggtgtggacacgccaaactatatcatttcatccctgccctctttcaagtctcatgtcctcacatttcaaaacgcaatcatgccctcccatcagtccctcaaagtcttaactcattccagcattaactacaaagtccaagtccaaagtctcatctgagacaaggcaataccctttcagctatgggcctgtaaaatcaaaagcgagttagttacttactagatacaatgagggtacaggcaatgggtaaatacatccatatcaattgggagaaattggcaaaaacagagaggccacaggccccatgccagtccaaaatccaatagggcagtcattaaaccttaaagttccaaaatgatctttgactccacgtttcacgtccaggtcatattggtgcaagaggtgggctcccacagccttgggcagctccacccctgtggctttgcagggtacagtccccctccccgctgctttcataggctggcattgagttcctgcagcctttccagatgcacggtgcaagctgtttggtggatctaccattctgggatctgaaggagggtggccctcttctcaaagcttcaataggcagtgccccagtggggactctgtgtgggggctctgaccccacatttcctttccacactgccctagcagagttcttcatgagggctccatgcctgtagcaaacttctccctggatatcccagcatttccatacatcctctgaaacctaggcagaggttccgaaacctccaatcttgtcttctgtgcatccactggcccaacaccacgtggaagctgccaaggcttggggcttgcactgtctgaagcaacagactgagctgtaccttggccccgtttagtcacagctggcattgagccagttgggactcagggcaccatgtcttgaagctgcacagagcaagggggccctggttttggttcaataaggcattttttcattttaggccttcaggcttgtgatgggagcggctgccatgaaggtctctgacatgtcctggagacattttccccattttcttggtgattcacatttggcttcttgttacttatgcaaattcctgcagtgtgcttgaatttctctccagaaaatgggtttttcttttttattgcgtcttcaggctgcaattttttaaacttttatgctctgattactcttgaatgccttgttgcttagaaatttattctgccagataccctaaatcatctctctcaggttcaaagttccacagatctctaggtcaggggcaaaaagctgccagtctccttgctgaagcatagcaagagtcacctttgctccagttcccaacaagttcctcatcttcatctgagatgaccacttcactgtccatatcactatcagcattttggtcaaagccattcaacaagtttctaggaagttccaaattttcccacatcttcctatcttctgagccctccaagtctctagaaagttccaaacttttccaagttttcttgtcttcttctgagccctccgaattgttccaacctgttcttgttacccagttccaaagtggtttccatatttttgggtatccttatagccccactcccttggtactaatttactgcatcagtttgttctcacactgctaataaagacgcaccccaaactgggtaatttataaaggaaagaggtttaattgaatcacagtcctgaggctgggaatgtctcaggaagcttacattcatggcagatggggaagcaaacacgtccttgttcacatggcagcaagaaggagaaatactgaataaagagagaaaagccccttacaaaaccatcagatctcacgaggactcactcactatcataagaacagcctgaggaaccacccccatgatttaattacctgctaccgggtttctcccttgacacgtggggattattggaactacaattcaagatgagatttgggtggggacatggccaaaccatatcaccaagatataaaattaagttgcctcactttaataacaaggttgagttacattttaaaattattattaaagtatatatgtgtgtgtgtgtgtgtgtgtgtgtatatatatatacatatatgtctttaaagttatgttaagtgttccatgtactactgtattgagcacatagaggtgctcagtaaatgtcaatgttaggtgaataaatgagcggataaaatatggaccaacttagctggtcagtgagtttatggttacttatctttgagaagcatcttttgcctttctccatattgagattgtttaattgagctgtgtaacttttgtatatgttattatatgtgtttaaattttgtatatattttgtctaccttagtagcaaattttattgagaatatttttttctcaaaatagcatccctttaaactagaaaaaaaaacagtttttatagctctcttttgaactaaatactaaagaataaattggtcaagttctttctctgatcatgaagtacctgcaaactgcttcccataaatggcagaaaaggttaagagacattaccaggatggctgccccaaattgttgctggtatcattaaaatagtcaacaaaaatgtggagcctacagccttgtaaaaataggaacatttaaatccatactttagtcatttcctctccctgatttatgttttcttggttgtttgcaggcgcagtcaacagcagtggaagagctggctcatgtgtggctcaggctgactccacaatcagagtgattatgtggaaatcaatcagaattttcttcttagaagatgtttgttctgacataatgactgacattccagctaatttttattcataggcttctccttgcacaatgatctctatttctctcaatgttattctgtgtctttcttgcttgcctgcacattctgaaaaaaaaaggaaagcaattccctacattttattttgatacttaatgttgtttgctaacatattcagaacacaatgcaactttatatattagagcacttataatatatattaggaaaacatcaattaggtaccaccagttattttagacaggtatctcttaggtaaaatgtggtgaaaatagaggggcaatgatagaattcatatgtgaaagagtcaattggccatcattatgccaaaattattttgtggttcaggggacattttaaactttaatttttaagaattaaactttaattaaatttattgtagtttaaatgcaatcacaaggaaagactctgaactggaaacaccaagccaagctctttcctagttctggtcccctataaaccctgaaagttaatgcaattattgtaatttttaaaccaccgagttctcagggtgattagttatgcagcaatagatagcctgaaaaggaccattctttctggcactgaaaattaagaagagtgattaacaacataagaatgtagtttgtgctgtctgccacagatttatgttgtagcttcagtgattgcttcaaagcacccttactaattgccagcctattgctgatacctagctaaattagcatgtgttagttttgataccactataggcatttaaaggatagctgatacattctatataaaatataattattttcctatctttagtttatcctaaagtagcagctattatattcgcttcttgattagctttatacataaccagagaaagtaaaatatcacagagtatatttgaagacataaaagtctttggacaaagctcaagtaatgaatcaggatgctattacatcctccacatgacagtaaatatattttatattcctaaattttaagcttttaacaaaagcaaattttatactggactatttcaatttctagggaaaggaaattatcatttactgtctttgaggctataatctatttagccattatttttatattgatcaatttataataaaggtaagagaaaatactaccacatatatgttgtttatataattttaactttcataattaaaatactgggtatactgcaagatgtcaatatttataatagcttatatttggaaacaattatactttatatactcctaatccattgccttgtgtgtcattgaagaaattgaagttcacaataatgactgaacaaatgctcaaagctggtctgtggcagaaccaaaaatttccatggcacctttctctttccatattggggtgatctgcctaatttgactttctgcttatatgtctagactctacccctcattccttctgctagtgtgttgttgaaccctttctattaacccactctcgatttttctgttgcacaatcaatctgtagcctgaatgttgagtcccaaatgcatgagctacctggccgagtaatctaactagattagcctgagtatatcactttaaggccaatgtaaagttatgttgtaactacctcatagttttgcagaggcaagaaatagaagttaaggaagagaagaagccaatcttgaatcagttagaatttccttggacatagaaaatctctacaagcaaaaacccatttgattgaacaagcaagcttatgcagttaaatatatcaaagatcttgtcacaaaaagtgtaaagggaaagtaaaataaggagggagcatgaagaagccagcttatattaaagattcaaagcagggatataaggaaattcaagccaaaaataaggaagaattcttataaatgccccaagaatgaattcgatgtttggtcgatattccaacagatttagtaatgctatttttaaagtcaacaggctgcccatttttgcctcacactctgactgcatgtaatctgtcaagtactctgatgagttctggagatgctaatgcaaaaaagatataaaatccttaccttgaaaatgtagttcacaatttagccatggagttatggcaagcatcttgtcttcaattttagcccctcctccatccctctcccagacacccattgtcctctttctcaccacatccacccccttttttgtcctgtctttggtgcactatttataattcttctcatgtctaccacaactattttgggtagtaagaacatcagtatggagaccccttaatcctaactaatatcaactctatctgtttggtattaattcttgtttattgaacttgaggcattgagtactacaaaaattataatacactactggtgaacattactttattaatgattaggttccacttggatgtttgtcattcgtatgtagctgttctctccttgtagcctgtaaactttctatggatgtcacaaaaagagttttaaggattttgcttaaattaaaattaatacatcaagaaaatactatgcctcaaacaaaaaataatcagttaatttagtttttagaaatcttttacaaaaaacgtgatatttaataatctttatgcaaggatttttgggatattaaaattgtcacagatttaataatacgttttattgtataaaatttttcttttctcttcaaagtgttgggagagtgaattctctaagtaaaaactgaagagtaagatgttatcattaaacatttcagaaaatgcacactatcgtagactgcgcactgtgaaaatgatcagctagtagaggttttggtgaacatatagtaacttttatcaacaagtaatgtgaatatgtgaaatctattgcttttccaaaagaaagaaacttttacacttcttggtaaagataaactttcatgtaagaaaaaataaaaacataattttagcaatccaaaccatactaaaatcataaacacttgaccacatgtttgagtaccccaaaaattgttcctgtgtggattcttcttctaggatgatcagtcctcatggccttactactctccatttctgtcccactgaggttagccaaagttcacttgccttgtcagttaagtttctaaatcagatgagttatgttttctataattgagttaaccacagttaattgcttaatagactctgtctacactaactgaaaaaaaagaattaattgcttggagaaaatgcattatatattttattcacatctacagtcatccaggccaaagtgacaaaggcactttcaacagtggccagggccaatggcgacagcggggccagtgcttagctcagccatgtgttcaatctagtactttgggatgtggatataaagaaaatgagttataaatgaacttctccttagagcttaattcattattattattattattattattatttctttacataagaaaataattttaggagtgctttggcaaaagtttaggtacaatttaagaaaatgccatttgtaaaaaaaaaaaaaagactagnntttttttttaattaagtttttacttttaatgatttagatttaggttttaaaaatgtatttcctagccaaggtctaacaccaggtatctgagatttttctaaattttctctgaaaacatgagacgcacgtacagttatttaaaatttgctgcagccatttttaatagattttttatgtttgaagagatgccaatcgcttattatagtaagctatgatagcaatgccaatgaatcctcaattccattgcttaaatataagtgaaataataaaggaaaagaccagtattgaatatattgcctcttcctgctacactctaacatattcactacaataaatggaaagttgcacatacaataaaaacttaggcaatttatttatttacttattttttatttatttttttgatatggagtctcgctctgtcgcccaggctggagtgcagtggtgcgatctcggctcactgcaagctccgcctcccgggttcacgccattctcctgcctcagcctccctagaagctgggactacaggcgcccgccaccacgcccggctaattttttgtatttctagtagagacggggtttcaccgtgttaaccaggatggtctcgatctcctgacctcctgatccacccacctcggcctcccaaagtgctgggattacaggcgtgagccactgcacccggccggtaatttatttaagtataattgataatcagggcaatatcagaaaatcttgaataatttgtactctaaaatgaatttatgcttttcagtgctggaagcattatagaggttgtttcaactatgaaatcattttgtcaaacgttctttgaagtctatgaccttaagtaaagcatttaaaacccaatggtttagaaacgtccagagaaacaagtatattggcaattgtaaataatttttgaagtatttagcaaaacagcgaagtacaataagcatcctattcacaattccaatgtaaaaagagatctggtcataggcagaattatactaagaaaaaccctatgaagaaaataaagcttgtttgttacctccaagatttcaccatctttttcccgtgtccctgcatctatgccctactgtttctgcttcctcattaatcttaaatcgacttaagtggatactggttgtttaaatatttcttatctgtatcacaagttcaacaaggaaaatatcttgataataaaaaaagccaaaggaagcttttaaaaatttacccatggattgtaattacccatgatccccatcctattcctttagaactgttagataagagttttctacacttgaaactttgagtgtttctaaaaatatttcctgctttgagcttaccaagttgatagataccgtccagacagggtgaactgaagcaagagtccctggctcgaaagtgtgcctggcatgttctaataaaacaaaaaggccgcacgggtgctcctaaaagggaataaagtcagcaagtggggagaggggcatgtatgacttcttgttgattattagaagaacattgagaaatgcaaaaccactttgtggttttgtgaatccactgctgttttcaggatacactgcgaggggtaatggcacaaaagggaaatctcctggttgatagtttggtaatctagacagaaggtggtgttggctagaatcaaggtaatagcaagtcgagttatcagaaatgtggaaattggttttatattgagaaacaagccgatggtgctgctgagaattgcacgtgtagtgagggagaacaaagggactcaagagtatatttttttaaccaaagcagctagaaagatgacattgcctttgtacccttcattctctaattgtattccccatctctgccttcattctctgattacctttcccaacaggtagctttagcttgtccacacctaactatgcttctgtctagggccttgacacttcgcgattccttccacctggaatgcagttgcccaagatatcctcatcaattatctctcatatttttcaagtttttatttgaatgtcaccttttcaatacaacttgccttgccccccatcttagattgtatccccctaaatacacttcctgtctaccttctccgattcgtttttctccatagcgcttatcccaatctaacaaacatattttacttattttatttattgcctatttccccagtaaaaaggcagctcaataacaaggatgtctgcttgttttgttcactactctctctccaaagcctggaatagtatttggcatataatagcacaataaatatgggttagatgcatgaattaatgcagggaattagccaagctatttactgtactctggtctctgagaaaatttgcaagcaggagaaagattgctctatggaaaaacgtatgaatcaaagcaaaaaactccatcatggtgtatccagatgaaagttgtttattgtaatttagtttgtgataaagtcttcatcataaggaggatgaaaacaaaagccctagtagtatcagatcctcagagaagagctaataagctgagctccttaacatgactcatgctttctctaacttgggggaatggttggccccaactctcactgagtctgcacactgaggaaaactcctcaaaatctagcagcctggaaggatgaatgcaaaagaacagtaacaccaatattccctctacccagctgacatttctctcccatccttcatttccttaccataaccctctgtgctagcccattgttcatggataatgtccaagaatgtacaatgatatacaagatcatgataattgaattccaacttctgtcatttttcttcgtgcccccccatatccagtgattctgaactgctacagttctgtaaaccaaacatcccttttccccaattttataactaaacgcttttacttttttattcttcctagaatagcctttcttatctcatatctttgtaaattttaattcatcctttaataatcatttatagcagttcttcattagtgaaattcctgatacatttcccaccctctctgaaaaattaattgctcccttattgatttcccattgattctaatagttatgaaatattttattacaattactggttcacacatctgaattctgcttggagctgtgaagaatctgaaggcaagaaacatattctactttctttgtataaaatggacttatcacataataatggctcattagggtgaatgaatgattaatattaacaaagaaaattgtcaaaattaggtaagcttcttttaaaaagttgaagttaaacattagccatatgttttctggaaaactgagcactttctgatgtgtttgaaatcacattgagaaagtcgtctcttttgctacttttgtttactggaatgaagggtaactggaaagatttcccagagaaaacaagaccacaaatgttttgaagtagggaaaaatattttaattgaaatagaggtggtacaaagacaagaaatatgacatgtgatacagtagatataagcgtatatgaaatatatgggatgaacatccatacaggtttcacaggactgaaaggtgcaactggtacagagagtctggttgttgaagtatttaaaactcacaatcaaagctctgatagtaggatgcaatgtcaatgattactaatcgagacaaatttgctcaagatcattgtataattacacccaaattccaatttgtgaatagatttactcatcgtgacctagctgataacatggaaagataaacaaggcagatacacagaacattttgcagactatggtggctgcaagaatagcttttcgcttgattcaggctttaagtgttagcctgaacactcagaacgcgatttattgttggaaagggattaacgaagacatttatttcagaggctactttgttgttgttgacatttttgttgttgttgacttttttgttgttgttcttccctctcatctgggatatttcccttgcccttctgacggcttgtcaatggggaggtgttcgttcctgctttatctattgcatatctgtctgcttaatatgaatctattacacagaataaggaaatacatttagggctgactaatgtaaaaatactctttgatgagcagtacactgcaacatagctcagagttttcaaatttattatattggctcttccaaatatgttattcatatttgctgagagttgcttttataaatttctgctttggagcatacagctcagtggaaagatatgtgtttatctgaattagctggctctaatcccaaatgaatatttgtacaaatctgtttttaacattgatattaatttattagacaattagaatatggcaaatgatgcaaagtttggaacttgtttcacatttttttaatggtttgtactcactcccctcccccatatacgagattttaaaagtctatagggatatcttagtacatatttatgcagattacttttttatttatggaaggggattgcttgatcctccaggtggttataaaactgctatttcattttgacatgatataaattggtttagagaaaacaaattattctaaagtctttagaaaccaaaatgatgctgttggagcatagtaataacgtaaataaatctagaagatggagatttttatatttctagaactagatgggtttgtcctggatcatgcctctgaatttagtctctgatttttatccaggggtgatttttgacttgtataaaaccatggaaaccaagagccatcataaagcaagaatcggtttacaatctttggaaatgtgtatttacgtagaccatgaaataaaaaatattttgttcaagaaaagttgtttttaatgctgctctgaacagcagaccaaaaataacatttttaagagcaagcaagtcgtttttgtgttttacttgcctgccttataaatatggaatgttggacccagaagaatacctgagtttaggaccatacattcttttaggtaaaattttattgaaaattaaagtatatatagaaaagtgcacaaatcagaagcctacggctcaatggatttcaagtgaatatagccatgtaactagcatgccaataaaataacacattgatagagcattacccgacccgggccttctcatgcctcatcccaaaggtaattgctattctgccttttaattattacatattagtttggcctattctcttgaacacaactcttcaatgcttgtaagttccattttagaagatcttgcaagtggaatttgccttctcccactagtcagtctttaaccaggagatatcaagatggaatcagaggaaatctaagcactttaagtggttttgccgtgacagcatcctttgtgattactgaaagaaagctggaagttgataaagtgatccatgttgaaagtacagattgtgctttgatagtggccatgttgttcctgccacaatgtttccctgcactatttttgcccaatattggatttaacagtaaaagtttaagtaatgccatattccactaacatataacaaaaaaatggaattagaaataggtagcaaattttaaagatcagagaaaaaggaattgtgacatttaagaattacatgtggttagagatctttatatatcaacatattgaaagaaattaattcagtcagttcaggcatgacgtttatttttaacaattagtattctattctctataatcatgttccacagtttaaagtgcttaatgagttcttactggaaggggactatttcgggagagtataatggcctttaatcacttcactcaagctattagcaggaaagattgtcaggaaatattgttacttttgttataaaatcaattgaactttcacttggatgaaacaagaagtttgtcaatatggtatataacctccaaggtctttctcccttttccttatgctatttccccctcgtcttcgccatgtgttattgattcatttgaataatctatgattattttccttcttaatagcctgagaagaaaaatagcttctaactaagcagctaccaagtccttaagctagatgctatgtttatattatctcaattaatcccactcagtgtagtcgatggtatgaccctgttacaattgtgcaaaatggagtttcaggaagatacacaatttgctcattatcaaactctcataacatccacagaaaataattgaaacacaaagccatatgactcttaacctctactgaaagatgcttttatatagaatctaaaatgttatgttagatataatatattggctggtgaagttttatcttttccaaaacagaacaatattttagtgttttctcagtgaaaatagtgaacactattcagattcaggtgatgatatctttgattatcctcatgagagagtcagtgtaggtagttcagtgggtctcaaagcatagtacctggacaagcagcaacagtgacatctgtgagtttgttacacacacacattcatgagccctaccttaaatctctgaatatccaagcatgcgatccaggaaattctattttaataggttctcgagatgattcttatatgcattaaggtttgggaaccactgacatatttcttaaaagcacgaattgcggaaacagactgtgtaagtttatattcatgttctgtgaaatactagctatgtgacattgaacaattaatttatctttctggatctcagtcttcttcatttatgaaacttatacaataatcatatctgcatcacgttgttttcagaattgttgaacacacatagaaaagtgtcatgctagggccaggcacggtggctcacgcctgtaattccagcactttgggaggccaaggcgggtgcatcacctgaggtcaggagctctagagcagcctggccaacacggtgaaactccatctctagtaaaaatacaaaaaattagcctggcattgtggcagcagcctgtaatcccagctactcgggaggctgaggcgggagaatcgcttgaacctaggaagcagaggttgcagtgagctgagatcgtgccactgcactccagccaggaaacaagagtgaaactccatctcaaaaaaaaaaaaaaaaaaaagaaagaaaagaaaaagaaaagtggcatgctcatagcaagtactatgttagtgatagtaaatgcatggatcttgttttcataatacaaattaattaatgatataaagcattcattaaatatctcaatatttggaaccttttcttttaataataaagtctagtaaatgttgttattgaatagaaatacacttttaaaaacgttgtgcattattttaaaaatatatgaatcagaaaaggaaaggtgatggaaaactcatacaaatatagtaaattgcactgtttttgtgaagatgattttatgcagaattcaaagtagatgcaattagtgcttcaaattagaaactgcaaatgatgaattcacaagcacatgatttaacaaacaaatcagagaagagaaaaagtttctgatgaatttgagtttctacatgtggatttcatcttgtgataagccattctcaggagaaagcatgagatgttattcgtcattccagaaagtgggagaacataaaagttgagaacagttattgcataagcaagaattatcaatgaacacaattaatttaatacatacacaggcatttgactgtatgagaaaaagcatttcatgttatttgctttgtagatacaatatcagtttcgatgagattcatgctgcacggatggttacacctgtcacctgtgggtgggtaatcttaatacctgtgatgacaagtagaccacgggggaggactcgcaaaggatttgagtgaggagccactgatgctgtgtaaatgccagagccgtgaccgtgcacttttggggggatgtgcttaaatatcttcagatttcacagaagttagggcatcaacggaaaatacttttgttttttctagctcatctgcacaagttgaacacacattgttagatagtgtgtatgtcagagcatatgtgaacaaatgaaggcgaaaagtcaatagccatacatttgtatttgtattgctctttatcaatctaaaaaggtacattaaacaataaaatgacaattcaatttttaacagcattctagactctagaaggtgttttctaatccactctcttaagccattctcacaacagtacaagggagaatttcaatgagaccaggtcacccagcaatatggtgacacagatgagacacctcctcagatttttgtttcaaaatttttgttctgcctactatgccatacatgctgtaatcatttaattagaatttatattttaataaatgaaaactaaagagtttttgcaattgtgttaacactcacgtgttaaatttgtaattatgtcggtaaataaaaagagtttaaatccacaccccattagccaggcgtggtggtgcacatctgtctgtaatcgaagttttagaaaactgaagtgggaggatcactgagcccagaagaggtggaaactgaagtgagctatgattgcatcactgcactctagcctgggagacagagcacgaccctttgtccaaaaaaagaggaaaaaaaaaaaaaagaaaacaaaaaggcgcaacacagagagaagtgatcttatccttatccttatgctagatatatattttttttctggtcagagaattacaagtctgtctaggtaggctcacatttgagaagagaaaatcctgttctattgacttagagagttaaagaccctgccataagcagagagggcacacgtgggactctgcgccaggacaggcacaactgtgggggacgcttcatagcagcttttgcagatctcctctgcacctgaagcgccgcctgtagaagctagatgaaacctcacaatgccaaagggttgctgggcttaggaagcacgggctgcatagggataactagatctttatggatcctgaagccactgccctttgtctggatatctgtctctttgtgtggccttataggctgcatttttcttgcctgtatgcctgaggtcttgatttagtcacactggcagggtacaaactggcctgactctgccagtgacttcacagtgcagttgcaatgtcatttagttaccttcccttggaggaactgctactgttgatgaagagtgctttggaccaaatattttatgggcccaaagttcatgtattaaagccctaattcctaatgtgatgatgtgaggaagtgggacctctgggaggtaaataaggtcatgagggtagagcccttatgaatgagactagtgtccatgtaagaagagatggaagatatgatctttctctccaccatttgaggacacagcaagaaggcagccttctgcaagtcaggaagagagccttcaccaagaaccctctctgtcagcactttgaactcagactccccagtctccagagttatgaaaaataaattcctgcattttaggccacccagtctaagacagagaggtaaaatatatagtgcttgggccactcgtttgttattaaattcactatgtattcagcttcacttatatccttagaaaagtttgtgaatgcagttgaatgggtggagaacggtagttgcagataatcagagaagaagagtagagacagggtgcaggggaaagtaggtcctttaaattgaaaaatgataacatgatccattcatataaatgcacttttgttcaattctgctccagctgtattatccagcttctctaaagaatggtgcctgtacaggacagggtgatctttaccctgatgaaagatggctctccaggcagatagcaggagagacattcctaattgattccaggagggaatgccaccaccatcaccactatcatttatgttgatatcaaaactgaaatgtcaatgatcatttctgttctctaacatttccaatcagataatttaaacattttactctaagagtttttcaactcaaatgttatgcttcctgttttgtgcatttgtattattaactctagtttcatgggagtcccagtttttatacatcactgtatagctttgatgttaacatgattttgagttaacataatttttgccaaagtgagtattaacctagtttgatcacacaatttggttattctttattctgatgctaagggaatccaatgatttttgttgatagtaacccatcaattctattgactgtaaagagtaatctagaagaaatttaaagaaaatttaatcagattttacgttttctgtcgctaatttggcatcttaatagctgtttattttattcgaggtgcatcctgagtcttgtaatgttcacattgcaatattaaagcataacagatgagcctaaaatgttcagtggttaatttgtacagatcaagatgttgtaattgcaataaccttaatgtggctaacccttgaataacataggtggaaactatgtggataaatccacttatctgcagatttgctgccacctcggttaccccagacacagaaaaaccaaaccctcctcttcttcccccttctcagcctactcagtatgaagacgatgaggatgaaaacctttatgatgatccacttccacttcatgaatagtaaatatattttctcttccctatggatttcttaatagcattttcttttctgcagctttattgtaagaatacagaatataaatcatacaacatacaaaatatgtgttaacttactgcttgttatctgtgaggttttcattcaacagtaggttgtcagtagtcaagcttttgaggagtctaagttacataaaaattgctgactgcgtggctggggctgggggagttggcagccataacctccacattgttcaatggtcaactgtataattttttagcggaagtgtaggaatgtttagtatgatacaaccatggagaaatattttgtataaatatgtgtaaaattaagactgtagaactaaaaataatacacttagttcattagttattaatagctaatattgatttagctctgtgataataaattgacatgcattacctcatttgtcacattgtcatgagatcaggatttttatttgtctttcatttacaaatgaggaaactaagtctaagaggagttaagtgatttacccagtattacatggcaaaaaaaaagtcagagtttaaacttaaagccgagtctttgcaattctaaagtccatgttcttagctactgcctttctgaacttattagtcaacctgaattctgaggatctcacaaaaagttacgtgctaattattttggaagcatttatattatgagtttctaaaattacaaattcttttatgtatgatagggaggtaaaatcatggcatttagaggcaaacatattctatttagttcccatttgtgctacttaacagttgtgaacctgacgagtaccatttagtaacctcaactgttaaggtgtgtaaacaagttcatttcatagaggtactggggaaagttaagcgagagaatatatgactaacaaaaaatatgattttcattttttccttgtgtgtatacttaaggggaaatttaggactgcctacttgttatcttccactgaaaacaaaacaaaacagaagattaaaaatacaaacatgttgcccttgtttattttgtctaactcaagttgttctgatatcatccatttctgtgtaaccacaagcacagttggtaaagattgagttagcaatgttccctcaattccagattgccttctctaccatctaatttctttcagtggtaccacaattcttccatgctgtaatagaaactttgaaattatattttgctatttttctcttttgcatcattattttacattttgttgtcaaatatttattttctgcagaatatcttataatcccatgcttctaatttctagtcagtgactttcttgattcttattcctctaatgtacaatccaaataacactttcttctcttctttcatttaacaagtaataatttaacgtcaacactgtgtcatatctgtggtgtcacctatcagtatgcagaacaccaagggattcccactgtagtgtgattcttcttcttgtgtattaacaccaatgctttcttggcctcttaacgcttcctccttgatatttttcagttccaggcactctgccacacactctcatggccacacacaggaccttgttaacacctggaaattctccatctttgaactatgaaagattagtatctgcaatcagtaaatggcatcatctctcatagcttttattccccaatgccttctattcagccttgaactttgttttttttctgcctgctgcttcttccctcattaagccagccacatcattcgatcccttcactcacagcattttcaagaacatcccctcttcctctttttatcttcagtcactctggtgtgaatatcttaacaattatacaatacactttcagtgttcctagactcctgttgttagagacagctgtgtaacagaatgccctggtgcagactgggggtccctggataccgagggtctccagtttcagctggcctcctcccttaggtaagagatagaaacaagaatcttagtattattctaatgttcaagtatctggtcttttctgctatagttttcccccataaatcttgatttttagccatattaagtgtttttttcctttaccagataaacaattttgtctccagactttctgccattttcactttttttacctgccaaactttttgtgtctttacgtactcaatttaaaatcctcctttatgagatttcagctttttctcttggactgagattgagaacctctctctgggctccaataatttcaaatgtctgcttaaattttgaagcataatttcattttatgagaatacatagatttcagactactaagcaatagaaatatggatacaagacatacacgggaccacttggggcatagtaagtattcaagaatactgaatacttggtggatatttggtgagtgtattaggccgttttcacaccgctataaagaacttcccgagactgcgtaatttataaagaaaagaggtttagttgactcacagttctgcatggctggggaggcctcaggaaacttagaataatggtgaaaggggaagcaggcatgtcttacatggcagcaggtgagacagagagagagagaaagaaaaaaaacagccacttataaagctatcagatctcgtgataactcactcactgtcacaagagaagcaaggtggaaaccactcccatgatccaaacacctcccactgtgccccttcaccaacaggtgaagattacaatttggattacaatttgagatgagatttgggtggggacacaaccaaaccacatcagggagtattataattggtaaagaatgactgtccctagtgcattgaaatgtaagtctcatggaactaacctatatttgtttaatgcaaatttgaattcaagatggcagactaaacatatgcattttttacttatctttccaagtctttgttaagttttaaacggattatataaaagagcaagaagacaagaattaaaaaagaagtagtaagccacatgggaagtatgcatgagagttagaagctgaggaagtgagtagtaatctaaaatctcagagaggttttgggttcataggtgtgcaaaaagagaatgagcattgggtccaaaaaacaaggcgaataatggaaggtgaatagttgaacagttgcgctgatcagtctagctttgcagctcattgtcaaagaagagatcaagttggaatttttggccaaatactatagggttgtctgtgatatttaatagtaactgagtgagcagcctgagagtcaagactgttagctatgttttgagaccccaaagtaaaccccttgcattttatcagttgacagaagagaagtgctctacatgtgccctgacttaagcttatttttcattcgtaagtgttaggtaatttttagtaatatcattagccttctatatgtagagttatgtgagaattaaaggtctctttccctgcaatctcagacagaattctactgtacatgcaaacatgtattatcaagtatggacaaaatcaattgtactgagtataatgaagtccaggttctctgccttttatgtcctctaattgtacacagcataaaatgttgactcaagccagagcacaaaatactcaaaggacagaattcagcttatcttatggtcagatatttgcactaaaataattgaatcagtgattggatacaaagacttggatgacatcacaaagtgttcaggctcttgaacttcctaggtccttataaccttcttttgaaacaatagaggccgggcatggtggctcatgcctgtaatcccagcactttgggaggccaaggcgggtggatcacgaggtctagagatagagactatcctggccaacatggtgaaatcttgtctcttctaaaaatacaaaaattagctgggcatggtggtgtgtgcctgtagtcccagctactcggaggggtgaggtaggagagtcgcttgaacctgggaggcgggggttgcagtgagtggagattgtgccactgcactccaacctggtgacagagcgagactccaaaaaaaaaaaagaaaaaaggaaaaataggagtacatatggaattctaggcatctcacaaatctttaacgttagtatttcttcaattaaaatactttttaaaaattctaaccgctagaccactagagaaaaatacttttggttttattaaatacgttatttaaccaacctctggtctcatcagagagaaaaatagatggcatgtttttacctttccttgtttcaggcttctgattagaattcctactagtcaaccatttccagggtgcacattcttaatatttctcaaaatttatattaggctgaaacctacaaaatttatttttttaagatcaaagaatgtcaaatattagcaagtcacatggtttatactgttaaagcaaactaaatatggcctgagaaagactttgtacttctgtatttgagaccttgtggatgaaccgcaacctaaattaataggcagagaaaattttaaacttaacttaggagttagcacttataacaatagctgggtcttggtaaatcccagcagccatacttcagccactcatacaccgctgagtattcaaactgtgttcaaataaggcaaatgccaatctgtaaccagtccagctgtttctgtacctcacttctgattcctgtatgtcacgtcactttatttgtctataaatttgttctgaccacaaggcatccctggagtctctctgaatctgctgtgattctgggggctgcccaattcatgaatcgttcattgctccattaaactcctttaaattagtttggctgaaattttccttttaacaataccatctctcctgggagagtcaaactcatatggcaggtgaggattcagagagattgttttccaaaagatagaaagtaaagttgccattttcttaaggtctaggcagagaaactggtatagctgtacttctaccatattctatcagttacacactgtcatggagcaggctcttatgcaatggaagaggacaaaggtggcctcatcttccctccatgctctgttacaaatatcaatctgtctccctttgcatgccctgtctttccttggattttaggctatttcatttccttgcaatatcagctctctgttggattcaagaatagagatgattttgtagtatgttccactatttttcccccaaattattaaggtattagtaatgctctttcatgttccatatcttaagtggaagtggaactttcttgctataacttttgaattagcaattctagactctagactccaaaggagtctgtatctgcaaaagttctgagggaaaataattgtgaagttaaaattctaaaaaagaaaaaatccttgtttaactaaattatcattctaaaataacaaaaaatgatattttataattataagaactaaggaaattgtctttatataaatgtctggagaaatagatttctgagaatatatttcagcaaaacaaggaaaaaataacacggggatatactgggactgaagtaacagtgcctcttaccccagagataagtgacatgaggtcccagaatcattttaagcaggcttagaagccgaatgtataaaatatatcatgtaaaatataacgtgacacagagggcacttagggtcattctgattcttgaccttgatctgagtttcaatgacgaaaatagattggccaaagaatgacatactagccacgcctttattttcattacatacactttttactccatactgcacagatatatacaattattttatcttcctaaccaggcaataagttacttgcccatcttcttattaacaataatgtagataaagtatcttatgaaagtagagaaatgtagtcagttatttgataagtgtgtgagtttgttcatatggtcttataggaaataacaaacataatttaaattggtacaggttgtacacagaacatttaaaaaagttctacctaatcttaaaaccatggatttttacttaatgtttctgcattttataatcattaaaaacaatggaaattttgttgagcttaatatgaattaaaatttttatattaggatatcgtaggttttgccaatagaattctaaaacttaaatatatctaatttgattactatgtaggttatgcactgtgactcattagaatatatgatgtgttgtttaaagtcataatgatcatcagatgaaatatggccatctttaaagttatctcatagatctaagtagtgaataaacgagacaagagtaatgtaaaaatggttgacattatcaatgaagggtcaatggataactgcgtggctccggttctgatactcagaaggaaaccacatcacttaagtagtaatatgaggaaaatgaaccacatttttaggaaacatcacacaaactgtaaaccaagaacactttactattaaactttttttcaaatatgccaatgccatgaaaaaaaacaaagagctgaggacccattccagtttaaaggagactcaagagacattacgaccgaatcctctatgtgatgtaacataagctatcaaagacattaacttggtcaattcataaaactgaaatctggaaggtagatcaaataaaggttttctatcaacattctgtttcctgaaacggtagcttgtggttaacaaagaggatgcccttgtagttagtactaagggttgtagggtccgtgtgtcagtgacttgcacttggcagtgagtgcgtgggcgtacgagcatgcacaccacacagtgcacacaggggtgatgcaacagtcagtacatccaggaaaaggatttatggcagctccgagtgagtgcgtgggtgtacaagcatgcacaccacacagtgcacacgagggtgacgtaacagtcagtacacccaggaaaaggatttaggggagctctgagtgtgtggatgtacaggcttgcacacacacagcacacacggagatgatgcaacagtcagtacatccgggaaaagcacttatgggagctctgtgtactattgttgcaatttttctgtaagcttgaaattgtcctcaaataaaagtgaaaaaatgttaccccaggaaggattggcacaacattattttagatgaatacttcgaaaacttcctttattttttgaaagttactggaacacgctgattacacatttgggatttaacccctctgccttaagtataaacttagacgtaagtgtaagaacccagtttaagttatcttgagaagcacaaaatttgagttactacacagtttccttttaaatggaaatgaaatacatttcaagtcatactaatatatgttggttttgaactacttgtagcccttccttagaaaactaaaacaaaaactctcttttaatttcatgactccttcaaatacggaaactatgaagatttatgtcttatgaagtttattttacacataagttattagattcttttaaaattattattattattatttatttttagagacaaagtctcactctgtaaccaagactggagtgctgtggcaaaatcatatctcactgcagcttcaaattcctgggctcaagccaccttcttgcctcagcctcctgagttgctgggattacaggcatgagctaccatgctgagcatacaaattatttggtctgatgaaataattattgataaaatcaacagaagtgatcattataagttaaatatttacagtgtgatttagagaacatacctgtagaaaggattgaaacaataaaatattattggcttggaatttgtatagaattttgcccttcaatatagactgtcatctaaacactcaaatagaagacattcaaatttacaaaatggtgctttattggccagcctagataatttttcttgcttcctcagccccctttttacttactcctgagggcttaatatcacagacaactgaaattcatctgcactctacttactatgtgtaaccagctgtgattttattttctgatgctaccacatgaaaaaaaaatttttttcctgagctatagatgttaattggtgtctttgtatcttgctaattaagttctagcaacaccttctccctcttcctcgtttgcacttaatgagctcacttgttgtattaatttataagataattagataaaacaaaaaaagttgaatttcttcaggagtggctttggaaagtgccccttaaatattcaaacatggataaaaatgtgtacattacaagacaaaaaaatcactttaagaagaaatatacttaatgttagcctgtagactcatactgacattttaaataatgtgatgatcagggcttatacaaaaaggaagagattgattcaaaagctcaggcaatcacaattattttggtgtaagcaaaacaggatcacatatggtacaacatgatgctcataccagaaacctttgcaatatttaagcacaacaaacaaattagttaagcaatgtgccccttggactctaattaccatttttatttgcatgttcatttttttctaaaatttttttaagccagtggccaggcagtattaaattctttgctgtttatcatgataccagaatttatttgacaaaaagtggaaaaatcattgacgtacagtgaaactgatcattgtttaatagtagaattctgtcgttcatcagcagttagggaattgtggaaattgttttgagtgagaacatccagatgttattgattccaattttctggtccaactcaaactcatttgggccattagctttccaacttgtccaatatcatcagaaaaggcaatggcatctcttactgctctatttttgtctttggttgagtaatggattccacttgactggcatatatattctggctgccctttaggaaatctaagcatttgatgtcaaaaatacacatcttttaaaatacttcttaatattgaggtaaagcaaacattcaaaattcaaaatatcaagctgtaaatgttaatactaaacaggaacatatccaatcgacattgaaattgtatataatgaacaagaaacaataaattaaagtggaaagtcataataatatgcaatatttcaggtattctttgatagatgtaatgacagaagctactaccttgcctgccccagtgttagtaacattgagctttccagctaggattagagcatttttatatgaatccttaaaaaatgcaataactactcctccaggagaggatgctgtccctgcttcctgagggatagcactaatatttccaggttgtctgctttacatcaagactttgctttaggatggaaacaggattgtagggagactgtgagctcaacagtaagattagtttgtctccatttgatcttttgatgaaatgcattggggtaaaacctcttcccagtgtcattagtagctcatgaattagaaaagataatttttctcctacatattcaagaagaatcagaaccaggtaattgacatagccaactaaacctctatagttattggttttgttctgactcaaatgctaacttgaatcccttatgactgttaagagcataaaggggaagagaatgcccagggaggcaactggagagacagagacagcagagctgtgagaagactgtttgcagaaaatattcttcccatgtgtggacttggcctttgaagcagagaattacaacaggaaattaggaataggctggtgtagcctcataaacaagtacaaaattgtgtcagcacaccaaaatatttcactagactgcccttcccctaggaggttcacaggtggtataataaatgaaatcagcaatccttctacatgtctcgcttatatggttattttggctcagccgaccattagttatttgtaagctggggcataaatacagacactagttgaatatttatgtacagctccagaatccaccttcactaatttgtctacttatggggaatatagctgtggggggcatggaaaatatttactctgggagcccttaaatgtaatgcatgaatatgaatgtgctcttggcacgggaggtcctggaactcttggtaggtgttgggtccctactgacgctttatcattttcttttttccttcaactgaatataaaactgaaaagccgcttttaacagttagtaagtggtgatactgccagactcatcctataagaagttagctaaattttatccagacataatattttttattagcttacttgtagagtccctcctcagagcccaactaaacgtggtgctaaacattcttttgcctttgtagaggaataacattctgagactcctttgttttttcaccaaacagtaaaattaaccaggtattgaattcatactctcattaaagtcattgttaccattcttttacaaaaaaaaatactcaaggagtaaagaaacataaaaattgacactaaaacaatatcacctacgttcatctttctctggatgttagatttggaatgtatgcatagaaaatggtcttagtgtcaaagatttaatgctgcaagagaaatcatctccaaaagaatatctcctttaattctgtcttcttatttatcaaataatatctagcgaccgcacttttcttttgttccttttgtataagaaggaattatagcggtttgccacattagagtactttaaaagtgcttcctaaaatttggtagagaatcttcttaaaattttactccaccctgcatctttctggatatctatcactcctgagatggtttttccaggcttagattagttttctaaatctctcagctttcttttatctcaagtgacacagcagttaaattacatcatgagtttagcctggactctcttgagtcccccaagaaggaaaactgaaattctgcaaaatgacctatatttaagggtgaaggaattaagagacatctcaagccgtccccttattagaaggtaaactaggaatcataaaataatatatttgaccgagtgctcagaaatgattaaatccaacaggcttgccaacagagttgtaccgtagaattgccaagggagttatcataaagcacagatactgggctctgcctttgaccttctgggtagataaatgccagtgattttgaaagtaattccctgtgattctactgaatctccacaaatcttgtgtaacctctcaattttaaaaagaagttttttttttttttcagtttaagccatttattcaaagtcaaacatgctttagtgatggagaagaatctgcttttaaatgtattaaaacaaattgataggaatcatgtttcttattgttttcctgtataaagttagacaaataggatatttttgaagttataaatcatttaaatacccttaaactgtttacaatatcgtttgttatatttttatcttctggggtaatgttatttaaattaaacgaggtactgagtgcttgctgaaactaactagaaatcttaggccttaaaaatagctatctcatatttttaaaagaaacatcaataatttttatatatttttaaatttatgagatggaaagttagcttttactaatcttatcaggctaaactgagtaataatgaagaaaatgaagagtttagaaatattttttggaatatcagtgaaatctctaaaaagaaaaaaaaaaccctcatctatatgtgtgagcgacataaagtcacactttgttgaaatgcaaaatggccttggaaaatttcatggaatgaaactaaatggcagcacatcacttttccagatggggtcttgtggttgtggctcagatcatgggggtgatggcaaactcttccaaaggaaaaatagtagcaatccagtcacaagatagtaccaaacatagactcacagatgagtaatatgtcagtttcttaaaagaaagagttgttaggaatgagagtaaggatgtgcctcgattacaataccccagatacgatactattctgaaaatggtgtgggggttttgtgagggatgccaaccacacattgtgctagaaatctgcatcgggaagaaatattttttgctacatgttacaaatatgcctatagactgtgattcaaataaataatgtgtttaggccaggcgtggtggctcacgcctgtaatcccaacattttgggaggctaagccaggtggataacctgaggtcaggagttcgagaccagcttggccaacatgatgaaatgccatctctactaaaaatacaaaattagctgggtgtggcgacgggcacctgcaatctcagatactggggaagcttgaagcaggagaatcgctggaacctggcaagtggagattgcagtgatctgagatagcaccactacactccagcctgggtgacaggatgagactccatctcaaaaataaataaataaataaaaataatgtttttataattttttcatagaaaaataaacctgaagttaggcagtgcagacttgaatttctcattctcaattcccattcattttcctgtgtttttgagggtttctcctggaaagtaaaacaattcaatgctttatcttctgcccttcagaagtcgggacatcatcacatcattttacctttaagatattggactggattcatagaggaatgagccatatacaacatacataggagtatgaagaaagggagacagccttcaaagctaatttagtaactaatattgtagtttaatgtaatgagaaataaaactagaagatgattgatagaatgcagagggcactttaaatcagagagacgatttgaaagaaagaaatatttttatataccttgatttattagagatagattaaaaagttcgtttaaaaaacgtgatcaagaacttgcagtgataagttattctttttcaaatatcatgacgataatgctgcataatcacccattcaaaaatttcacggcttmgaacaacaaatattactctggagctctctgttctgtggttggctgagttttggctactcttgacttggctgagctgggaggatggatctgcttcaggctgcaagctggctgagcttggctcatcacgtttcattacgaggcacagactgaagtgtttggagaagcccaggcagtggcatgttctttaaaggcactgagaggagcttatgaatgaatgaagcttaactacataagcwcacttgatgaagtcaaaatgcaaggactgggaagtacatgccaccaaccatcaagccatggtaaagctgtcgatgtactacgggggagtggagtgctggtacgaatcattcagtctttcacaaaacactggcaaaatgcaggttattcagacagaatcgttaaatacaaaaacctacttaaaacttaagggtgtattagctatctgtctccaaatgtactttttgaatttaagttataaggactttcactgcagaaagtatgcaataatgaagaagataattgctttggtcattgggaaagtgtttttcaggtagaagtgaatgcagaaacaaccattccaagcaaaaccaatgacttccagggtaggctggaaagagaattctcttaatagaaaagaaagagcacttggaattgagatagagacgctaaactgagctactcctgttggggctttgctgatccttcatggaatacactcattaattatcacagaagccacctatgtactctgcattcattgggatttgatgtataattggttcttaacttctctatgtttagcattttgcttagaagttagcacttatcttcaggtattataaggcttttaaaatgacattttcccctctagaggaagtatgcctttgtttgtttatttgtttgttttgtcttgtttcttagagacagggtcttgctctgttgcccaggctggagtgaagtggcttcatcatagctcactgtagccttgaactcctggactcaagccatccttctgcctcagtctcccaagtagctggggctacatgcttggctaattttttattttattttatttttttagacatggggtctggctatgttgccaaggctgatctcaaactcctggcttcaaactcctggactcaagtaatcctcccacctgaaggtgggaggccagcaccttgacctttcaaagtgctgagattacaagcatgagccgctggttacaagacatggccagaagtatggggttttctatgctttcacatataatacatacttaggttttctcgatgatgaaattatgtttgggttacttttagtaaaccgtatgtgctttgaattaataaaaaagttgtgattcatttattttcaactgctacttcccttctcttttggaggtgctccgttaaaagattccctttatgttgtgtcacagagtctgaattgacacaaaagcatttccaggcattattcttgttcccggttggctgacatagagccccactcactgatggcactggggaaggacagagcctgttggacaaaccaaccctaggcattagtatcaaatggacaaaaggatcctaagacgtttagacaactgttgacttttatgaaactgagacaaaaatggtaagaaatttagataaatatttccttttgtaaaaatgacatgaattgtaagtttcctacactgtaaattagaaaatttaaattatataaaactatataaaattataatttttttcttaatattggcatttttatgtgtactaaggtatttacctcacttttagaatctcgaattctattgggagtgtattattttcaactcataaatcaccttttaaacatttgattcttataacttttccttctcaggaaaactgaacctatatttatagaatatggatgctccagcagctggttcaaaaaatgattccgtagtaataatcacatcaattatatggttaaaatgtgaagcctgagtcaccgaaaagttaggtcatttaatttgttcaatgcagtttctaaagttttcaagaagtgtattagatttaaaagagacttgaaagggaatctgatacaatgtcattacaactgagaattttctcaccagaattcttgaaagtactgaaggatgcaaccctagtgacattctcattacacatgtagatcagaaaccaagaagtctatgagtaacgtttggaaagaacaatgtttaaatatgaaaaatgatgtgactcatgattgaaaaagaaagtcatgtaaattggaagtgcaaaaactttacaggagaaatctatgagaccaaaaataggtagtaaaataaaaatgaaagtaaatatggttgcctaaaacacattaacaaatgaaacaaatagataaaaccaatgagaatgggcagcactaagagtaacagagaagtttgacccaggcaattttgatgaattacttgggaaatctggtaataatcaggtaatatgggagcagcatgattagttaataattccactttaaaaaattcacacagaaaaggacagagtatatatggaagacatgcacagcttctatattaatgtgacactgctctgagtaattaaacaccgtttccaggaaagatttgttcagttgttcctagagggtgtggatacatccaggacattcagcttcatgacttctcatttgttttagtttttatcttttaaattgggggaaaatgatgtgttattcactgatcttttcttctgagatgccaatctaaatctgttatcttattaaacaataagcagattttgttctgatttaggcaattaccatggttagtaaacaagaaaattaccctaacaatggaattaggttttgtggacatgatcaggtcatctttttgaggtatctgccttttcctgcattcataataaccactattactctgattacttttatactgtccccataagtagtggagttctcacttacgcaatgaaaaccagaattcagaggaaatgtaaccttctgaattcttattgtgcaaatttcctcttcattcagtgccatgctcacctggaagaaataatttgtcaaatattcttgccaaccaaacagcagtcatattccttcagagaattttcacactaaaaacaactattagttttacgctgacagcacaagtcaatcctaatgtctttggatcatgaatttatctacagatttcagaagaaacaagacaaacatttttgccaatgtcatccatcaatcaagtggcaaagcagatgtgtggatttcaatgcagatagtttctgtccagctgtctgctctccatcttggatgttggttttgttgtagggctggctctcctcataaacttgagatggtcgctagcaccttgtaagggtatgcagttcttccttggcatccactgaaaaaagagtggatatctttttcttaggaaattcatagttgggtattcagtcgcatgtgcattcttaaacaatcactgttgccaatagaaaacaatatattaactggctcacctaggatcctatacttgtagacagtttcagccaaatacaaagatcttaagaaagggaggattggttcctctacctcaagaaaaattaaatcaatgttgatgcaagagtgggaatgcatgttgagaggcaaacagtaaacacaacaaaatgataaatcagatctgctggccctcaatattttcttttctttgccatatcagaaaatcttctatgattcagagctcactcattaaatgcattgcccttggataaaagccattggtaaaataaccaacaagtcatcctcctttgaacctttagccatattcatgtctacctacattatgtatatttctttgcttcccacattccatcagagtaaaatacttcgcaagagccagccatgttctaggacatatggacatgaacagatttataggatgtggttttctcatcccaactcttgaaggatgaatggggatcatccatgcagatgatggagaaagtcttcaaagagaagtgaagatcaattctaacaagacgataactaaaacagcatagatgttcagagaactgcaagaagcctcattgcttaacccaaaagnatgagagagaagaggcaatgattggtagaaattagatcttcaaggatcttgtattagcacagaaaaagctgaagatgtattttatcacgaatagagtaccaacaaaataattttcatagatgagcagcatttttaccttatttatatgagaattccttctggccagagtgtggcatatcacttgggaacaggaagaatatattattgcctttagtgaggcaatgctgaggctattatattattgcctttagtgaggcaatgctgaggctattaccaaagtccaggctagaaatgaaacccaaatgaagaaggcagaagtaggtttcttgaggtgaaaacagagtcaggtcctccttaatacataggctcttacgactgggagataattaaatttagtggatggggaaatgagaagtgggggagcatgacctggttttctgacttagtgtcatagtgtgtggaaatgcattaagagaaacagaaatcgtacctgaaggaaaatgcttgtagaggaaaagagtcattttaaatatgataaatttgatgtgtacgagacatttcggtgggcaggtctaacaggtaacttacaatacatgtgtgcagagccctgtagaagaatctaggcattcagtgtctgctccagggtcatcagtatgcacgtggcagtcaaaacaataagagtggctgagatcatccagggagagtgttttgaatgagaagtaagcaaatagaagacatttggatgctgcccaatatttaatgaatgaattaaagatacagagcctgtcaaggagctgaagaatgaaaggtcagagaaataggagcatatttgaggagaagagagtgatcagcggtaaaattgaatgaacagacaccaagaaagccaaagccagccatgtagaagagcttcaaattagaaattttttaagaggcattcttaaatgaagactgtcctttattttgttttgaaagatgatttattgattctttaatcactcaatattgcaactgggatttcttcagaggtctccaagtctcctctattttcacagatcaaaattctcaggtgcagagtatgtcaggacctattcaaggttacacatttggctgacaactgtgtcaagactaaaatttcatgatcgttatttcagttcatctgaaataaatatcctccaaacataaaccataaactttatgttttaagagcacatacacctctttacatgaagtcctccagctttgtaactcctccattcttatcaggtatcacttcttcagacatccctctcttcagtcattcctctcttttcttctcagcctgtatatcataaatacctatcatttctctcttgttgtataattgactccatcatcttttgttcttcatttctacctggccctaaaacctacacatcagatcaatcctatgttctctctttttaggctccatccttgtattgaacacaatgctgtaattatgtgaattggtctaatttgaattcttgccatctaaatccttcctgagcccacagtgctgtagagaaaatatgtttctattctgggtcagcatttgacgtgctttttctgtagggttatacattccctgattattaaaagtttatttccaagctctcctttcctgtgtattcagaatatacctcacatgctgcttcacagagacagtcaatactatcagctagtagggcatacaactgtggccctgtcatgcctaaatcatatcaatttacatcctcccttctccttccactttattccccttttctttgtacaatgtcaatctgtttcaaccttggctactgcttcagacatcttgcattgtcagtcattatccttctcttgtggatctccaacatcttacctctgccaaatcttttcccttcatcagtaaccataatcagactgtatttttagatgatgtaaatttctataattttatgttagctctggcttatccctctttcttcctactcctcctcttatagtcgtgtatttaggtcacaagtacactcttaaacaataactgttgccagcagaaaacaatatattaacaggcaattatcaagtatgaactccgaatttccaacagaatatccttgatactctgtgtatgtgtgcttgtgtgtgcgtgcgtctctctctgtgtgtgtgtgtgtgtgtgtgtgtgtgtgaagacaagtttatgacaagaaggagagactcacagaaggtcatcaaaagttagaaatttaaatgagaatacgcgtgaaagtaattttctagcctgcacctgccaaagtgttttctcatagttcatgtgaagaaataccaataggttgttgtcgttagtccactacacagtgttcacctttaatgtaggtggcatgggcctaaacaaggatggaaactgatattaacagagtgttatacagcaggtgctgtactaagggctttatgaggaagggttaagttagtcatataataatatacttaaagctttaatttcatggtgggatagttcactctcatgccatcataattgttgtacaatcctgaattaaagaacttttcaagatgttattaatgaaaaatctttactgagtgaattctatctgaccctcccagtcaaaaggcttctactcaaatttggctaaaccctattagtgatgtgggtttctgactgctgccgtaacatttatttggagataagatgtgctatatattacagatggactttgggaagtgactgagggtgacagaaattaattaaccacaagcctccaaatgaaatttttatgctggtgagtaagaaatacaaatttctgaaacacagcggtatgaaataatgcagtatcaatggttaaggaagcttcctaggttttgaagttctatattaaaagatagatatgtaacaaacctgcacgttgtgcacatgtaccctaaaacttaaagtataacaataataaaactaaaaaaaaaaacaaaaaaactttgataagagagtacatcttattaatgatttcacaatgatgcctaatataatttagtgtcttggtaatttaggtaatgaataaatatgggatttcttttcaaaaaatataagtaatttttaatgaaaataatatgcagaaataaatacggggtaaagtttaataattaacaaatattccagaaggccagtagtctgcgttggtcagaatgaaactttcacagaggggagagtaaaagtgaagcagataaagtaatgaaataattgatatcagtgtctctaaagtaagaccgaggaatttgaattttgtaggcagtgaggagcctctgaaatcctgagaatggattcaacataagcaaaatcgtattttggaagcagccagctggcatgcatgggtggttggcgagaagtctccagtgagcaggtcattgcaggtgtttgtctcatgtactagtttaatgtgccggcaggggggttgctgtgagggaatttaagaagcctgaatcagcagttcttagcaactacatgaggggattaagacatgtaaaagaaagtcaactgtgactccaagatttccctgaataagttatatcttattccaacgctattttgaatatttccagggtgtatattctgaatatattcttgatatattcaagattcaacctgagtaagttacatagacctgatgacattcagtattcgaggtcagataacaatgtaactgaattctcctgtaaagagcaaaaatatgttttaattattttacaagtactcaacatattaaggaacttatctagagtttcctggaaactcaagtcacggctgttgttgattttattaattaggaagtttacatgaaccaatatagaactacactgctttatatgtataataggtcctatttttgaaatggctgatacagctttttaagtggtttttaaattgagacaacttgacatctagcttttaatatttaaaggaatgaactaggatagctattcaggtcatttgaatattttgtgcaaattctcacactcattatgtcatgtctacattcttgctgtttcatataactcaaccctccttttgaatatcatgatttaagcactcataaaatattactaaagaagccttgaggctctaagtaacgcaataattagccctcctctaatagcccaatagaatacataaataattttctcccactatttcctccccagatattgaracctcaatccgagttttaaaaactgacctatactaggtactagagatctctattggagatgctaatagattgtaaactgcatctagaaaacattaaaccagtattctaaatggtttgagagtcttacttttattctgggtcagccaactttagattcttttgtgaatgcatctttcgtctgcacttctgctctccaaataatcccctgtaacagttattttttttaatctttcacacttttattctacatctaaaaccttgacaggatttgttaatttatcttaaaaattctcatttgtaatatttatcaaaataaattagtttcgagtaactatatcttgatgttttttaatacaggtttctaacatgagactgaaatctaaaatattatcatcatccaaaataatctgaaaaactgaaatacaatatatacgcacatataatatagttacagtgaataaaatctagtatttgattgcgtaacaggtgacaacagtcgacagtaatatattgtacattttaatagaactgaaagagtataattggattgtttgtaatacaaagcaaaaataaatgtttgtgatgtttgtgatgatggatatatgcccccatacaaagtgctgtgcctcatgcgtgttatcccagcattttcacaggcagaggacggtggatcacttgaggtcaggagctcgagaccagtttggccaacatggtgaaacccgtctgtactaaaaatacaaaaattagcagggcatggtggcaggcacctgtaatcccagctgttcgggaggctgaggcaggagaatcacttgaacccaggaggtggagattgcagtaggtggatattgagccactgcactccagcctgggcgacagagcgggactccaccttaaaaatatatgtatacaaatatatatacatatatattatacacacatataaatgtatgtatgtatttatacatataaatacatatatttacacacacagagggtcattatgtaacaacatgtcttcaaactgaataattttagccatcttgtcatataaagcctctaacaccacagatttaaaatttcttcctgggaagtaaatattaattaaggaaatcccaacttcttttacaaatcaaaacccatgttctccataaattaacatcataaaacattttttgttcatgtcaagcggtcaggtgtctttggggagtttagaattacctgatacctctgttcttttatatcaactccataaggaaatcccactgcattacttggtatgtgtttctgtaggcctctttagtgtaaaatttaaaagaagggggaagtttaagtaatatcaggattaatgaaataattttcaagtaaaatatatttccatgggtttacacaaagtatcttcatctgtcagtgactcttaacagcagatgcgtatttctcactcccatgaaaagttctccactggtccactgactgtgatctttgtgtcttttacccttttggatccaggtggaaggagtcccctctttgtgacactgaagtttccctagaaaaaagtaggagtcatatgatggttcttaaagtaatagacatcctttctgctcacatttccttggccaatgcaggtcacatggtcaagcctgatgtcatcagggtgggaggtgtgatcttcctataggacaggggagcaaatactttcaatctgtcataaaacctgaatgaaatagtaagatatctgttaaatctatgtttcttaaacacacatgactgtctacacagggttcctttgtgcattatttgtaatgttaatacataaaacatgaaggagagtgtgtctcrttctcatgatcaaattttacctgttatcttttctctattatcaaaatgctggtagtcttctaatgatctttatttgtttatttattttttagttattgaataatgataatggtgtctatttcagatctacaactttctgagttttaaagtcatggaggaaaaactataatgaaataaaatataattttatctaaaaataaataaatttggtgttaaatccaagcatattgttattaacaggtaatacttttattgatttgggtgttttaggagttttaggagcatagaaatatatcatacctgtgtttactttattaaagaatcttttgttagaacttcccagacagcatttttggagatggtaacctgagatcatggtgtcatggtgtccttactaatcacttttaataggatatttaaaccccctttccagaaagaaaacaaggagcttccaacttcccatgtaccccatcacaaatcatccttcctctggactgtagtaacacatctaccccgtccaacacatctaccccatcctctgaggtcattgtgttaataatgtaaccacttctctcatttttctgcagtttttctccattcctgtaagtgtggtgtattagtcctttctcatactgttataaattaatacctgaaactgggtaattcataaagaaaggaagtttaattggcttacgtttctgcaggctgtacaggaagcatggttggggcggcctcaggaaacttatgatcatggcagaaggtgaagggaaagcagacatgtcttacatagtgggagcacgaagggtgcgtgaggtgccacacacatttaaacaaccaggtctcctgagaactctatcacaagacaacactaaggagatggtgctaaccattagaaaccacccccatgatccaatcacttcccaccaggcctcatctccaacactggggattacaattcaacgtgagatctgtccctacacacagccaaaccatatcatatgtcaatgttgttctctccctgaaaacaagaacaaggctgggcatggtggctcacgcctgtaatcccagcactttgggaggccaaggcaggtggatcaggaggtcaggagttcaagatcagcctgatcaacatggtgaaaccccgtctctactaaaaatacaaaattagccaggcatggtggcacgtacctgtaatcccagctactcaggaggctgagggaagagaatcacttgaacctgggaggcggagattgcagtgagctgagatcacactactgcattccagcctaggtggcagagtgagactctgtctttaaaaaaaaaaaaaaaaaaaaaaannngagcaaaaccttcccctgatgctctatatccatacatgtttttggctctgtggaccatatggactctatcacaattactcaactatgtgattgcaatgaaaacagctatgacaatataaaaatgagtgggcataacttttttcaataaaactttattcacagaaacaggtggcccaatggtggccggtagattgctgactcctctgctatagtctttctgttaacctaccccttactgtttcttcaaacaatctgcttaaaaaaagtttctatttctcatggtttccagattcttacctctgtttcatgcttgaaaactctgcaatttgacctttatacccaaagttttctgacagcttggggcaagagtggctttctgactgagtctgaagcattatctgtgaattatcttgggagtacatttccgtttggctctcctcactttagacttcttaccccatggatactctcctctgttcggtgaaactatccacccttggttctcttccagtatgtgaggtttcttctcagcatcttcatcgttaagaatgcatttaactgtaggagattcaaaaacgcaacaataaccaaaataaacaagaatttttttcagatttcaaacctaacatctggagttaaggagttcaaggttggtgcagccctttggcaatgtggccagaggtctaagcattttcctatttctgctccgtcttccatatcattttggcttttgttctcatgtttgttgccttatgggaacctcaggtttgaaatgccatggacaatgcttgtgtgtctaagacaaaaaaaaaaggacaaaattagtttgttttttaaattctttattcaatgaatcagaaaggaaaagtgtccctaagaccctggcagccatgtctccttaggtatccttggcctgaattatgccagacctgaactttgtcagttcagtgcatgagagaagctgggaaggttcatatttctagccaggggcactgcctgcttctccaaattcggttttcattaggaagaaagatgagttaaatggatattggctaaacaattgacatgtctcccagagtgacctgtgcaggatatttctcctcccataactcggtgttagtgttctaggaatttatctttcgacttctttttctgttaaactgcatgcaattcctgtgcagtctcattcactatcttagcatgacacrtaaggtgctgatgctcaaatttttctaactcagattttagtatcctatatccatctcctaaggggtttcaccttctggtttccccacgtgtatttcaaataaaagatagtctgaaagtaatgctgtttctttaaccggctatttctcatacatctctaccttgattgtaactataaaaatgataatcaagaaactgaaactcaacttctcctctcactccttcaactgctatactcaatcaactgccaagtgccatttacaaagtttcttaacatctcttgaggctattaacgtattttcatacccactgtcattctcatgactagtttcttggttaaaacctgtattatttctcactctgtctattgaagattacattctcacctggttattctgcttcccattaatactgctatcagaacactctctctgaaatagaaaccatttttctaggttaaagcccttcaacggcttgtcataattaacagcaggtaactcatacagtccctaaacaatcttatttatcccagggtattgctgaggacttcttaatctttcactcagttcagactcactcttacagctttatttggtttacaaaggatatttacctgatatctaccaggtatctcaagctgcaagactgaaatcattaccttcaaataacctccatatctatactttgtccttcgtgttcccttgtttagaagatgttttgtcaacaactccattcctcctagaagttttgtagtaatcatccctgattttctttctcctctgcttcatcactaaccagcctccttttttctgatcagccacaacatcctattgcttcaattctcttaatgcctctcaaatatactcactccgctctagtgtggtgattacagccttacttcaggctactgtaattacttgcctaaaatatgaccagattcttttaatcttttccatctgttcgttaaaagaatttattctagaggttttattttctacaatggagctacgattatattattcacttcttcaaataattcaatatcttaccattaccctctaaatgaagtccaaacttcttaccatagtttagaaagcttttccagagctggacacatctatcatagataatgctgcaggcaggttgtatctgtgaacctgtcatcacctccctctttgtacttaccacactgaggatgctgggcactgcatggcttcccctattaccatcatcatggtcctcactgtaactgtaattggaagattacatgtcctaatcctccaccctttcatcacatcatgggccttctgatctcaaccatgatgttcttcctatgcctggctctgtgtttggcaaatggtaagggccagtctgtgcccttccatgcatggatgactgattgggatgtcacctttgctcctatctctcatcccatcatcccccatcgctgcacttgactcactagcgttttctcttccctaaacagcagattcagtttgggtcttgaggcctttgcactttgtcttctctctgtgtgcaagcctctgcttttgttacactgcttgaaggattgtcacctttcaaaacaggagacttccgcatgtctgagaaagagctttaagggccgttgcatggtttggctgtctcccttttcccttttgcctgagaacgacgtttcaaatagaagctgctctttcaatctggtgaaacggcatgaggagaaaaaccatatttaacccagaggtgaaatgcaatgtcagtgagaaaaaagctaccgtgagccactgagatttggggactattccacagcacactccaacctagggaaatctgacaaaaacagaccatcatatttgaagatttgaattcaacttctctctggtctcttagccttctatcaatgtatgctagcagagaatgctaccttcttcccacagtaagaaaagaagaagaaatatcctaccttctcctcagatgtaaattatgagcttggatttccttcctgtataagttctatcagcttcaatgcatgcataggtctcttcaaaaaataaaataaataaaatagctaaagatccttcctaaatgctacttatcactccatttaccatgtccctagtgctaaacaactgtttataatcagtttaaaaaaatagttttgttctctccattcccattttgtgagctccctccagcttctcaacctttttcattttgtatttcatcctggcaatgcatgtaaacaccctttaatgttattagtcgtatgtgtgtccctaaaggcaacagataccctttccgttcccaatttatcagaagactcatggatattcaactttctggaccattccagattttataaaatgtgaccatcatttgacttcagtaactacaattgcatcattttgctcttgttgctttgcctctgcttcagattgatctctaccctaaaatgttgctccttcacaaattaacatataactgaatatgcaacattttcacttggtgatctcaagatacatctcaaacttaacatccccaaaacaaaatatcataatttttgcctttacaaataaaaatctgtcactacaagttacgtttcagttttagaaaatcataagaaattgaattttagaatatgcattctcttgtgtcgggctttgaaagacacaatgttttgtgttttagtgtaatatttttaagatttgtccacattgcatcagatttgcccttttttattgctgagtcataatttgtatacagatataccaactgaatccagttatataaaattcatctacaattattttgtggacttatgtatttatttttcttagggaaatgtttaacagtggggttttctggtcatgtggtatgcataaattgaaatacgaaatgcagaactttctctaagcgactattgttagggtctgagattttaacctacttataagctaacatgttagtttattaatgccttatggatgcaagcagaagacacaaaacttctgggtcagagaaacaggactttattatccacagtagagcaatcagcatgagcatcatgtttgacttggctttttgtatcgtccacgtcccacagggatgacacagagggcccagatgggtggctgaagattacaggagaggaagagtgatcttggggaactcttcattttaagataactggtgagcaaacctaaactttgtcttggataaaaacatttcctcgtccctcaaagtggctcattgcaatcataaccctgagaaatggcccaggttaaaaaataataaaaagtaggagagtttgatactagatacttttctagatattttgaagtatccagaaaacgtgtggtattaggagagacccatggaggacgatttcacaacagctgagtaattttacattcccattagcaacataggaaaattatttaatttcagtaattctagtaggtgtatattaacttgaatttccttgaagaataatggtactgaacatcttttcttttcttgcttattgagcattcatatgtccttttttgcaatgtgtatgttcagaattgtttctttttaaattgggttacatcttcttatttttcagttttaagggttctttacatattattaatacactttctttgtcagatatgtgcactgcaaatatttttctctcagtctgtggcttacattttcatggtcttagagaaaccttttgaagaacaaaattttatcttggtgaaatgtaatcttttattttttagcacttagtgcttttgtattctaagaaatgtttccccaccccacaagtctgaaatttttatcttatcctttcttttacaagtttataatatgatttttgcttttttgtctatatttagttttgagttatttttgtgtatggtgtgaggtggtggtatttaccttttccaggtggaatcaacttgttctaccaacatttatttaaaagattgtcctattcctgttcttttctgattgaattatgtttgtcctttctcccactgaattctgatatttctcaaaaatcaaataataatatttgtgcatttccagttttgggctctcaataatgttctttctttatgccaatatcacactgtcttgagtgctgaatatttaaattaagtactctagccagaggtatttgatgggttccaatccattacatttattattattattataactataataataattattaatggttgtttacagaaggtaggctagtcctgtagcaaccattttgccataactaatagtgtgatattctgtttacttacaatttgatatttttcttcctttagtaaattggagattgccagaaattccttactatttctcccattgaaatagggaagcaaattcacctcaccttgaatgtgggctcattttattgacttcttgtccaacagaaggtgggacaaaaaaaaaaacattatgttattggacttccaagactaggtcatatgaatccttgaagcttctttccagctctcttggaacactttctcagtgagacccgagatgctatgtaagtctaacaaccacctcactgctgtactggggaagacacatggaggtgttctgatggacagttcctgcctagtccagaattccagatttcctgccaagatgctaagaaagtgagaatagccctcttggatcttccagaccagttcatctgccgttagtgttagtgtgaattctagaaataccatgttgaaaggaaagctccatgggtaaatacgcttctgctaataagtgggataccagaacggctgttagcagctgtcaggtggaagtggttctcgtgtcagattccagtggaagttttcagtgtctcttttccttataggcttaggatgtttctctactgctcccagcagaggtgctcagcatactccaaagaactctgactttgatatcgtgccaatcagggttcgaattcacaaatttccatttataatctgtataacattaaatcctgttccaatgtttctgtcattcagctttgtcatctctccatacagaaaaatacccacccaatgtcatcccacctctgctgcctaaacactgtattaatgttaagtggcttccccatgctatgcactgtctataaaatagggatagtatcaccttcctctggatgcattgtgaaaagtcaatgtgaccatccacgtaaaaaatttgatgttaggcacagaggatttgcttaataaatgttaggtattattcacatgaggacttgatgaaaaaaaggtaaaagcatgtatttatcacataaaagggtcaaataaatgccagtttccttcattcttttccttttagggcactttgaaaatatggaaaactagttacaacacagcctcaagaagctcatgattcactggttacttatacaagtgatcctaattatggcttgagttgtagttgttttacaaaatgtaaaaattattgagataataattagttatttacaaaacaattttgctcgtagagattttaaattctgtcattaaaaagacccacaagcctctcaattgcaaagaagttagcatcacctttttttttttaccaaattcgaaaaaagcaataatctaactacagaataaaccatgggcggtacagtacaaaaaatgttcttatgtttttaaaagttgtgcagtccattgatcaggcaggcagtggtggggagaacaaagccaaacactgaatacacgttttgctacaaagaacctagtctaatcagttccatttagaaatgcactttcatttgactatatttgcaaatcatcatttttttttctctaaaaataatatggagtgtggaaatgctttcctatgcagaaaggtttttttatttattttgctgagtttcaggaaatgaagcttagttgctaccttgcatagaaacaccaaactatagaatgcacaaatttagcacagagtctgccacgtatggcaattttgataccgctacctacaattcacatttactgcatccatccaattacacccatggtatcaatgcacagcacttagagcaggctggcagttcacaagagtgcaacggatgtcacgcagtctgcatatcagtcaatctgcttcctgatatgctttaagaaagcctgttcctcagactcacctgaaatgcaaagagagaggtggaggacgatggcccatgtttcctcttgtgtacctacactgcagttcttgttgatgaccatctaatgcaaactgtcccacaaatctttcaaagagagtaaaggtgaagccagtccctatgttaacaaacctcaaccttatttcagcagatggtaaactttgattttgtttaagaaccaaagcttcaacagcttcaggaaaacatgtgtttgtaattcatctccattttaatgccacccttgcatggacgagctacatctcctgctccaggtgaatgggttcttacgttctggacactgtgtcttcatttcagttattgatacctagagttggtgagtttcaagccaatctctaagtcaagagtttatttgggagttgggtttccttttgaaatatactccctggagcctcaggctgttgcctgttcacctgtttccttttcagaccaaatcatggaaaggaccaggttatctctgatccatttggggtgtgtaaatatcaagaaggataaggtacctttcctggacttgagaacttatagcctaataagagaagacaggaataaaaaaagaaaagttttagttgctatgagactggcatataaaagtacagggacaggacaaagaaaaaaatggaaaattatcagaaatgggtataaagatggcttcatagaggaggtaaactctgtctgagaaattagaaaatgcccagaaagacatcaaagagaaggataggctgaaaggtggaaggcataaatgctgttaaaaaaggcaaagagtcatgaaatagacaatgaatttctagaaactagaaaactggacacaatgggacagggcatggaatacaattaagtgacctctgatttaatgttcaagctagtatcaaaggagatgctgtgaattctaatcttgaaatagcacacataaaccagagctgccccaggcaaattgtgacatatggtctccctaggcataaagttaatggtatagtcagaaggttaataacgtaggaaatgaattgaaatggctgctctgacacacgctacaaagttggaacctgatgcaatgtggtaggcagaattttgttcactatgactttcacccccggtgccagctttgtgattatgttatatgcatggcagaagggacttgcagttgtaattaatgttgctattcacctgactttaacagagggaggtgatcctgggtggtccaggtgggcccagtgtaatcacacgagtctgtactagcagaagcagaaggcagacagatnagggaaagaggcaggacagagatatttgaagcctgacaaggacttgacatggtattaatagttttgaagatggcggggaacataaggaagggggtacaggtggcctctaaaagctgatgatgacctctggccaacagctgttgacctggagaagaatgtgtgttaaacaagtgtggatggtgatgataataatgaagatgattttgcttatatgctgagaagacatcatgttaggagtgattacagataatgcagcaaaaaaggagcaaagtgttgaggtagaggtgagagaaggggtgagctcaagaggcaggcaggaatccttagtcaggcacagtggctatacattccttttcatttctccttggacttgcagatgcgaaacagattccttttctcagatgcccattcattaggggtggccatgtgactgaattccagccataaagatcacatgtggcattttaaggcagaagcttttcccttctcccagcagaatggaaaagctgaagcaataggaggagatgcaccatacaatcgaaggaagcagagaccctcaatatggaacaacgagaaacatccctgcagtaatagttgaacaaaaacacactcccattgtgttgtgccctttcttgacattttagactgttcattttcacagctggaccactgcaaccatcacacatgtgagaagaaggtgggtctagaaggaagaaagtgagggaagctacaaatattcatgtttgttagtggggaccatgaaggcgagatagatttcaatttcctcggccgggcatggtggctcatgcctgtaattccagcactttgggaggccaaggcgggcaaatcacctgaggtcaggagttcaagaccagcctggtctaacatggtgaaaccccatctcaactaaaaatacaaaaattagccaagtgtggtgatgggcgcctgtaaccccagctacttgggaggctgaagcaggagaatctcttgaacctgggaagcggaggttgcattgagccaagatcatgtcactacactccaggctgggtgacagagagagactccatctcaagaaaaaaaaaaaaaagatttctattttctccataaggtagtggaaatgggatctgctgacctcctgagtgtgtaggagtggaggtggagaatgggatacccaaaagcagaggagctcatggaggacaagaactgtgaggactggaagagaaagcatgctaggggtaggattgcagaatagagctcaaacttccaggtcaatgatgagggttcagcaggacttggacactgggcatttgcagtgactccatgtctcaatattgtctgtatagtgaacagatgctttgaatgtgggagactagaataaatgcatttttataaagatttttgattaaggcattagtaaatagcttcagtagaactgtttacttctttctactgcaaagatatcccaagggtttctagccttcatcctcagttgctttcttaatagttaccatgaatatacgtaaggccatccataatttcacacctatacttatcatctcaaggcaagccttgttagacaggcataagctcataataaattacctgatccagataaggcttttttttttgtttccccaattacactcatcaaccacaaattaagattaattacatagattacttggtctgtaaacatttaactaccatcaatggtatgaatgaccatgttaaaggaatttcctaagtgcaatagcagagtactaccattccttgagtatggatagtcaatattttgtaaagctataaatacgggaatctgtaaagaatatattctgtatgtggagtccataccaaatctgttcaaaatgcctatgttaaatgtaattagtatattctgatttataatctaccatataaactcattaaaagaaacccacaagcagctcgccattaaaaaaaaaaaactgttaaattgatggaaatctggtacttattttttaggcattatgcagtgtgcttcattattatacacagattcttctcactatagtatcgtttctgttaaaagctgtgtgtgtcactcatacaggatacttacagagcgtttttaaagcagtacataaatacatgaattatttccaaatgtgagttaaattgcaagtcacaatttagttaagtagattagtgaatagaaataagtgatttattttaatagccaaaaaacaagcttaaagcaggtgaaaggcatagagcagacaaaggctaaattttatggagcatttgcacatttgcaagatttcattaaattttctcaacacaattttcctcttctagtaatatgggagactagatattctaactggtctttctactaattaaaaacacctaaaaagtcttgggaaatttgttttataaatgaatcaatgcaccagaaagaaagtaagaattctcatttgaaaactaaatagagaaataaaccttgagaagaaagaagaattctgaaacaggtttgaatttgaggatatcacccaaaaatcttgacttgcaaatttgtttgcacagcctctcagagtgcaggaaacaggaggacatccaggtccctaaaaagatgtgagttgatcataagtactcttgatgagctggaatgatgagaaggctacactcttagcatagctgtgagccgaaactaaagacaactcctttctccagctgatacaaggtaaattgtcgataaacttgaccctgaatggaaggtaaacacgtaaatacacagagatacaaacatacacacaaacctcccatcaaccctttaataagaaagaaaggaaaaagctagacctccctccaatttacacttaacgcatggtagatacagatatagacatggatatatatcacaaaaaacccagagtttattttataggcaatttacatacggcaaaaagaatacaaatctttttggagaatttcagcttcattactaaactcatctctagagaatgttactagaaaaatgagcactcaccagcagatttcactaaagaatcaagaaagaaagaaccatgaggaagaacttgcaaacacaagaggcatcagaaagaaggctgtttagtaagaacccgtaggaatgtaatcacacatggaatataaaatctatatttaatatctttaaaggaatgaaagactagttttaaaatatgatcatggaaaaagaaaacataagaataaacatgatgatttttaaaagaagaaccaagtagaactttcagatataaaagaaccagtggtcctgggtatgaccacagcaaggacagagctgagtgccttagtgaactgagggacctgaataaattacccggaaggcagtgcagacaagcaaggaaataagtgcaatgaaggacaacctagcacaggtggaagaaagaatgtgaaggatgaacatatctctcactggagttctgaaaacagaagtggcaggaaaatataaagattgtaactgaggattattgatgactgatgaatgatgacaattaatacattcatgaaaacatataaatactaaccaggatagttaaattaaaataaaacactcacactttaacacaccttatgataaaacgggagaacaccaaagtaaaaagagcattgtaaaaatagtcagcaagaaaagacagattaaatcccagagagtgacagttatatcaactgctaactttccaagagcaaaagtgacattagcagaaagtagagtgatgtttgttctgtattgttctgaaagaaaataactgccaacctacaacactattgcctgtaaaacttacaagaggccgggcgcggcggctcacgcctgtaatcccagcactttgggaggccgaggcgggcggatcacgaggtcaggagatcgagaccatcctggctaacacagtgaaaccccgtctctactaaaaaacacaaaaaaattagccgggcgtggtggcaggcgcctgtagtcccagctacgcgggaggctgaggcaggagaatggcgtgaacccgggaggcggagcttgcagtgagccgagatcgcgccactgcactccagcctgggcgacagagcgagactccgtctcnaaaaaaaaaaaaaaaaaaaaaaaaaaacttacaagacaggagaaacccagagattttgtccaagtcaatcctgattaaattaaacccaaaataggagtagagaaataagaacttagagaggactaaaatggaagtggggagttgagagcaaaaatctgtttacatgggtaaataaaaatcaaaataatacaaaaataatcatttatcttgggataaaacaaaactaaacaagatagactaaattatgccatatcgatacaatatagcctggggaaaatgtgaagataaatttcctaaattccctgtattgtttagggagaattaccagtttttaaattatttttaaacttaggtaagttaactgtaataaaaaaattccttgggtaaccgagtagtttttaaggaactgaatataatgaaaatacaacatataattcccaaaaaagtaatcacaaattaatgagaaaaataatcaaccatctgaatctataagtaagaacatcatataaaggtgggataaatagaaataaaaactaatattctaaaaataagtttagtatgtgaataattagaatatgtataaattaaataaatactccaggtaagaaatcatcgatatacagcctccagggtcttagaaggaaacaaacagcacacttaactaggacaacctggtgacagtacaatagagaaaatatttttaaaagtatagatataccctgttttataacaataagaagattctcaggggagggtatacaaaatataccacatgcactgccaatgaaagtgtaaactgtgtaaactttctgaaaacaatacaccccaaaaacctgaaaaacgtaatacccttaggtcctaagaaaagtgacactaagaaaatatgtatctatagacatgcttattattccatgatttataattagcataaatgtagcaactacttaaatttccaacaacatgaaaatagtatttaaaaaattcattaatagcatggggcaatactcatttcataaggcatatgaatcaagaataaaattcaaagaactccaactgattaaatagactccccttggccaagagtatctcaaggaaacccaaaaaactagttcagaccacaataggaagcggggttaaacatgcctccttatacccttccctttggagttcaggcatacaactgactgacattaatattaaaatagagatcagaagactgacaacacagactttttgtaacaagaagataccaaattctaacctgagtctggtatagcatcacatgacagatagcagcaggctttgaaggaaatcaaggtatatatagtatatcaaatgtatttctttgacatattttgaaatgaccctgaaaagctgttttttgtagaggaaatttgcagcccgtaaataatctccttcccttactagatattttctagagtctgacatcctttaaggtatgataggaaatacatatgatctattgtctctgaagcctgctacctggagacttcatccacataacaagaaccttggtttccataatcccccttatcttaactcaattgtttctttcttttcttttcttttttgaatttcaggctaagtttattttttattttttttttattccaataggtttttggggaacagctggtgtatggttacatgaataagttctttagaggtgatttctgagattttggtacacctatcacctgagcagtgtacactgtacccagtgtgtagtcttttatccctcaccaccccctattctttcccccaagtccccaaagtccaatgtatcattcttatgcttttgcatcctcatagcttagctctgacacatgagtgagaacatatgatatttgtttggttttctatgactgaattacttcacttagaataatagtctcaaattccatccaagttgttgtgaatgccattatttcattcttttttatggctgagtagtatatatgccacaaatatatacatatactaaatatacatactatatatatatataaatatagtatataaatatatctaaatatagtatataaatatataaatataatatataaatacatactatatattatatatacaaacatatatacacatatagtataatatatatactatatatattatatatatacacacatatatatatacacaccacattttctttatccacttgttcattgatgggcattcgggctggttccatatttttgcaattgtgaattgtgctgctagaaacatgcatgtgcaagtatcttttttgtataatgacttattttcttctgggtatatacatagtagtgggattgctggatcaaatggtagttctacttttagttgtgtaaggaatctccataatggttgtactagtttacattcccaccaacactgttcccttttcactgcatccacgccaacatctattatgtttcaattttttggttatggccattcttgcaggagtgaggtggtatcgcattgtgggtttgatttgcagttccctgataattagatgttgagcatttttccgtatgcttgtgggccatttttatattttctttagagaattgtctatacctccccttaggctccacttccaatattgggggtcacatttcaacatgaaatttggagtttggaaacatgaagtttggaaatatccaaactatataagcaggattatatagatacaataaagttcaatgtatttttcaaggcactcattatttatatatttatatatttatattatttatatataaaaataatatattatttatatatataatatatatattatatatataataatatatataatatataatatataatatataatataataataataaatattatttatatatataaatttatatatataaatttaatatgctatataaatataaatatataaataaagtatactccacaattgcctaatacagatttcttttacaaatccataggacacctataaaattgacagatataaaatgtgtttccatggtatttaaaagatttatgttatgcagataactgcctctgaaagcagaaacattaatttgcaaataaataacaaaaggacaactagtttacagatcaatgaatgccctcttaaaaaagtcttgggtcaaagaagaacccaaaatagatattagaaaatatttttaaaaaatagataatgaaaatatatattaagcctagtaacttacagtcagacagaaatggatttaatgcagatattagaaaagaaaatactaaaatgaataagcttggcatgtattgaagaagttataacaagacaaggaagaaaacccaaagacagaagtaaatctcatggtgaactgtagttcccataatccccacaactagtgggagggacctggtgggaattgaatcatgggggcaattacctccttgctgttctcatgatagtgagtgagttcttgtgggatctgatggttttataacctttgctctgcacttctctttgctgctgccatgtgaagaaggacatttttgtttcctcctcctccatgatcgtaagtttcctgaggcctcctcagtcatgctgaactgtgagtcagttaaacctcagcctcaggaatgcctttactagcagcgtgcgaatgcactaatacatcccatatctccttaaaatgtacaaaaccaagctttgcgctgactaccttgggcacatgtcatcaggacctcctgaggctgtgtcatgggtacatccttaacctttgcaaaataaactttctaaattgattgagacttgtctcagatactttctgttttacaaattaccttttgttctagaccactcacaagagtgaccatgcaaaatggaagtgtgccacttactcagctagaaacgctccttagcttttcctctcactgggaatgaaagtcaatattcttaccttgacctgtcaggccctgtacttaagaaaagaacagcatgctttgacctaaaattacctctgaatggtctttgtctgtaaaatggaagagacatggagaggcgccggcacccgaggtgctttctaaaataaggggtgccttaaaagtcgtgttgaagtttgtcttcctggaataggaagtgggtggaatattttaattagggaggtgatgtgattgaatttgtttataaaattatttttggttaaatgtaatagagaaggaatttgatacagtgggtaataatgaagaggaaacaattttaggaatattaaaatatcccaggcttgaatgaacgtagagatggagaaatgtgtaaagactgaagaggctgttgagagttagatggaaaagacaagtggacggattagtgttgggataagaaaggaagaaaggagtcattgatggggccatgtttcagaaggtttaggggtgaaggctgctgcaattcattgagaccagagcctttgaaagatagataagcatgcttgggtgcagtggttcacatgtgaaatgtcctacgaaacataaaagtgaaaggaggagacaaatataataaaaaatatatattcttgatgtcaaaactaaaatataaatattttggagacttttgtgtgtatttggatgctattctcatgctcttttttctggaaaaaataatacaaaacaaaaattatttcacgagttctcaatttttgtccttctgtttttatcagataaatgctaataactttcatatctttcttctcctgcagtttcccatgtcttccaaatttatttcacatcattatcttacttttcctcaaggccgttttttctcttgactacagcaatgcagatttcaattctgccattgaattcccagacatattcgtcatccccattttcatcccccaccaccctgccattttcttcgtgttaacttgttttcctgactcacagaaatcaccttttcctgtatacatttttaggatgtcagactttattctaatgatttctcctagttgccccccaaaattgtattctacrgtgtgattttaaagctgaattttcaagatgatatttcatatctatattttcacaagcttttcttctatgaatgttattgtcagctgtcagggtgtgagatggtacttgatactacattctttccaagctgttgcctgaatcggtttaagacaaagtcattactaggctgtaaactgttgctctgcaaaattgagcagcacgtatttaaccactcatacttcttagctctccaacactttgagtcaatagagtatacaaacacctgtaatttccagtgagcacagctcccaggctctctctctgtctctctctctctcttttgtttttttttttttgcctcagcctctcgggctttatttgtgggatttgcaccttcaccttctgcatgcagtgtgccatggctagttccccttacatttttgtcatgattttggtagaggcaatgatttcctggttgtagaaaaaagggcagcaacataggattacaaaagtattgctaagaaattgcaacaagctacttgcagtttatgtatgattactcacagtttttggatggtgcaacccttaatttctgaaccagcaggtgaaagatgagagaagaataagagacctttctatagatcttcaggcagacaggcttgttggcttcctaatatttcggtgggatactgggatgggttggaggcaacatactgtttaaataagtagacagttttttaaaaataatgaattgtgtctctaagatatatttttaccagaatgatactatataggaatatgcgtaaacccctggactttgatctcaagcaaaaccttttccctattatccctccctcttaagtgcatgagtttggtaaagtactacagaaatttgttctctcacagttctggaaactagaagtctgcagtcaatgtgttggtggggttggttccctctggagaatctgttctgtgctcctgccttaactttagggcattgccggcaacccttgacttgtagatgcatcacttcaatctctgcctgctccacaaggtgttgtccactgtgtctgtgtccagtgtctttgtccagtgtctgctttttcttctaataaggacattagctatatgcactcaccctaattaagtatgatctcattataacttgattgtatctgcaaacaccccatttccaaataaagtcacttttcctagggttaggatttgttttttttttttttttggtggagggagaaaggaaggaagtgggcacagttcaattcataaggaaccaactaaatataaatgccactgtggtaagatcagcttgaccatgtagatttttaaatggtggttttctttgtttctattgcgttttttgctcatcttatcagaaaatttgataactttagataataaatatgaaggagtaaatcattaaaaatttaaagtgaaggccaggcgtggcggctcacacctgtattcacagcactttgggaggccgaggcgggcggatcacctgagatcaggagtttgagaccagcctggccaacacgatgaaactctatctctactaaaaatacaaaaattagccgggtgtggtgacaggcacctgtaataccagctactcgggaggctgaggcaggagaatcacttgaacctgggagatggaggttgcagtgagccgagatcatgccactgtacttcagcctggacaacaaagcaagactctgtgtcaaaaaaataaaaataaaaataaaaataaaaaaataaagtgaatcccacagatttgcttatattctttataactagattaagtgtctacaacagggctctttttgactaactttatggggatatacaacaggtgccaaccactccacattccaaaagaaggcaaagacttgctttgcaggacttgcaaagaggtgtccaaaatgttttcctggccttaggctcagcatccccccgaaggttatgaaggaagagctgtggtctccccttggagagattggatggatgctgagtgctcatcttcttccccttccctgacagacaacttgatgtgcatccctggacttacagggacaaagaagtgtccgatttattccagaaaatatttaaaggatgagaggcttgcaaagaggcccagagcaaaatcaaagaaggctatagcctgaaaataattttattcccccgatagcaggccagattgcatctttcttatcactctctggtggacattgtgagacagagcttagccagggattatcttagatcttgtcaaagaaggccctggccaatgaggcgatctctgcagaaagcagctggaagtgcatcatcccagatcccaggttgagagaccagcctcaggagaacagctgaggttgagggattcattctacctgggaaaactgcatgtgatggataaccattcgtgggcagggatctcaaagaacccccaagtatgccctgaagaattcagcacccaacctcctattactttcaaaggaatcaaacaacggtttccaagggggcatgccaataactttactagtgccgtgctctccctttctctgtaacacctctcacttcagtcctccgtgagccatagtgtttcaagggtgtgtgatgaagcgatggaagcctcaggtctggaaataggaagaaagtttactacaagcggcctgctgattaaagtgggcccaaacttgtgaagaaaacttggatcaaagttggcatcttgattcttatggagtacacagaattgcaaccaataaaagagacaattcttgagaggaagggtgattagaggacattttgttacctgggagtgaacagatactttatgagaaatgctctatatttgattaagtaacagggatttgcctctcaaagtgggggtggttttaagtaggcagtctgtgggggcggggtaagaaaatggatttctgattttatctttgctcattttccaggttacgtaaatattaagaacattgttaatttactttaataaagaagttcataaatagtccaatattaaaagttgattaaataatacttttggaaatacatgaattttactgaatgccctctagccttactacaaaaagaatgctttgcaaataataaaagctaaataaaaataagccagctccagccactttaagtgacggaacacactctgtaacttggggatggggacagggcaggaaatgaagaaattaaaggcaagggcgcctcactgaggtatatcaaatcctattagaccaggtcatttccttggctggcaactggacagggctcctattgtcttgtctactttggctgaaatcttttatttatcctccacatttgtttcatttgcaggtaattctattcctgtttctacatttaccatgctggatcagttttttccctgattttatttttaagttactatgatattcgtactaaatatgtaaatgtttattattgggttttagctgtttctataataaagagttgtagttattgtaagttgcatcgcactaagctttaaaaatgtatttctccactgtagagaagtatgttccattgaaatttgattgcacacaaagcttgacatgaggtttattctctttgtgaaataaaccattcaatctggactgcatccacattcatctgaaacttgaaggaaataagtcatctttcacttatgttttaatatgccatatttctattaaattaatggaaggttagacctaaagctcaatgattggacacttattattaatgattctttgcacatagagtgcatggatagctcacaagaaaatttcaccaaagtcatcttatatatttctcataataatcctaagaggtagggttgatagacattagcattctgacatcagaattggagacagattcttctgtctcatttaagggatttgcccccaaattaatcagtccatgataaagccagctctataatattactctaaagaatattcaaaaggtcccgggcacagtggctcacgcctgggaggccgaggcaggtggatcatctgaggtcaggagttcaagaccagcctagccaaaatggtgaaacctcgtctctactaaaaatacaaaaaaaaaaaaaaaaaatagctaggagttgtggtgggtgcctgtaattccagctactagggaggctgaggcaggagaatcgcttgaacccgggaggcggaggttgcagcgagccaagattgcaccactgcactccagcctgggcgacagagcgagactctgtatcaaaacaaaaacaaacaaaaagaatattcaaaaaggtgcatggggcaaggagaggtcatttcacatcctcttgaggaacacaggtgactccagaccacaattctcctagatggccgggggcccctgctcccctccttttggttctagggacttgattcctgaagaggggtcatgcgccaacatctagtttagagtttttctattacaccacctggtctcttatattaatttgtttccctgatntttttttttaatctcctggatcacaatataatcgtttgaatttttgttgttgtgtatacaagggctcccaagaaatgtgtaataaaagtggttggtgggaaaatcttgctaacagaatccagtagattaataactaagaaaataaggcacacacaacaaaaggttgtgcatggctgcaagttcaagagtgggaactgattagagtggtagaataaatacatgtgcatgtgttctgaatcgattagacatataaaaagatatctagattctttgaaaaattaataagaaactttttttctaagcataaatatgaagttcaagtataaacttaccaaacaacagagaagtgataaagtgctagcataaaaaattagcatcatgattattctgtattgtttacatagatctatcaagtcaaatgttgggtcagagccattctttattcagttatcaaaatggtagagccatttggatgagttcagagacttcttctttatgataaaaaagataattgtaaatcaaaaaagagtttaaaggctatactaattaaacagctaattggaaattggaagatttgtttctccaaacttctactattttttattttcttttctgtttgtggaagttttggaaagcaacattttattctgtgattagcatcaaagagtttcaggcatgggttataggactggaccatgcatacttgaagtgtacttcaaaccataacattctatgagatttcgtgagcaactacctcttattgataaaaagaattgctgtttaaaccctattttaaagtacttactttttgctttctcaaatataaggatgatgtactatggattagtaatatcattacctatggaaacaaaagatataaaaatttactgttcactcacttctccttaatttccaagaacattaatcttgaatttaagcttaaacttactttaaacattatctttattatcttattttctatgaagaaaataatccaacctatctactagtatgccactttaaaaacattaaaagccagtggataactgcaaaagaagggcttttaattttatataaaataataaaataatttattctattgataattccaaactctcaaataatatcttgctgcagtgctaaggaaatggacaaaggaagaaaaaacagcttttcatgcctttcctgaaacaattgcaggaaatttttgtcacgctacaattattctttgatcatgaaaaattcttttaaagacacgatagccacaaccattttatcttctgacttactaagcagtctgagggtgaatagagagtttcgattccaggttatggttataattactaactgcaaaaatcctattgcctttcattaagtagttaaaatatttaattgagactacagtgtgtctgcacacagcgttgtaccatgcataattatccctacacatacaggaacactgagggtacttttaacaataaaacagatcatcaaaaaattacatttttaatttaagttttgactttaatcttctccgtgattaaatacctatctctgcattttttctgcaaatgaggacattaagctaaaacaaatgaaccataaagtgacgggaaaaaaaactttgcactgttaatataaatggataaatctttaatatgtattaaccattgcactatgtctttattttctaacagcttgtatgagaaagaagaactggtgatgcagaaagtcaaataccgccagcttagcgggtcagcatcctctcctcccacataagcagagatcggagcatgagataaaatacctggatgccctttgctccagcctcgtgctcccacaactttgcttctgacagagtacttatctctctgaccactgggaaactgctaaaagagagaaacttgaaaaggattggacttttctgtgcaaatctctttgaaaattgccacctccaggttagcttttaagagaagcccaatatattaggaacctgaaaataaaggaaagtttgcacattgaaacatcacttgctaatagttctattattggaaacggaaatatggaattctagaaaaagaaatgtcattatggggttaggaattaaccacttgctacttatgttaatgtgacgtggtttaaaaaagctgcaggaagttcctgaaattattgaaacaaaaataaagtattttcccctggaatctaagtaatgtaagtgaaattctttaaacattctcttcaactttatatttcaaaattgcttcacagtaatttcttatgttatccatcacttgtctaactggaaggcaagcatttttattgttttagttactatttagctttatgaacagcattcttgctttgttgcaattacaaacatttatttccatagggatggaaagattatgctttgctctctctgccaggtaccaattgtcaatagaaaatagagccaactagagtaactttagctcttcaatcaacacatccagtattaagaaaaaaaatacattgatatttgagacgtaaattcaaatctttattcaatacgcaagaagtgtaattgtgggagattaggttgggaaataataaaaagctgtataattagagtgtcaggatttacaccctccactggaagctactatatcaggtataactccgcaaaattgtagatggttggcaactaatccttgctcacatttratgatctattactatgtgccaggtgttctgtctgaaacagcatgggaagaggaatcagagacagaattgccacctatgtggggccttgctggggtgcagaaattttgtttctcacatttttgaaatgtaatactttgatctgaattttactcctgcttaaggacaccaagatgaaagcggatggcaccctgccccccaccctggtgtagtttgttaagaaatgactttagttctatgaaagtggattcttagttataaacataaagaactatcaccggctagtaagaaaggattttattgaaaagatgttgggagttcatttatcttcagggattctgcagatgggcagagagactagaaaaccaagagcacgaaccaggcataattcaaacttcacaacagtgagggtaccagaacagcttctagggaacaacgccaggcacgactgcctggaagttgctggttacgggtgcttgattgtcactatttcctggcattgccagctgcagaggcagctaactaacagagccaggggtgcatccggggctctctttatgggggcatccacagtgggaggtagtgggttttgatgcaggaaattactgtgttgtatcttgggttttctcaatttatacaacaaatgtatacatacgttcagatggaagtaagaagtaccacatctgagagcggaagaggcactgtaatcacccatcccaaagaagatgatttcttaggaaaagaagtgagtttgggaaatatattagatgtattctcctgtctcttccatattcttgggaatttgagccatcacttatctctgatgtgccttgcttgagaagtggtttctatactatatttgatgatgtggatctgataacacaatattcaaatattttccagctgtgttaactgagtctctagaggcagatctcctgagaattgtcagttgtgtttattttccagttaagtctactttcagagagccattattgaaagagaaaagtttcaacagaaagatgattattgttaatattatcgtggtaagaccacttaatgtgagatctatcctgttagcacatttttacacacccactgttgtgttgttaactataggtgcaatgttgcacagcagacttcaagagcttattcatcttccataataaaactctgtaccattactgttgaacagcaacttgccatttctccctcctttcacctctgcaacagaatgataaacctggagagcattatgctaaataaaataagccagttacagaaggacacatattgcatgattccacttatatgaagtatctaaaataataacgcttattcaaatacacggtgggatttttactgggaaaaacgctcgctctttttaaaaaaaaattgagagagatttgctttagttgatcaaaattataagctaccggaaactccccaagatggcatattgttgaagccatagtgtgtgcacaggtgttgaataggcccttcagagataagaagagtaaagtgtggtataaaaaagagaaaaagtgctagaatgcagtcattgcaacattaaaagaaatgctttatcttgggggagatcctttggccaaactatttcaacttggaaagatgtagtaatataaaaagatttcaatacaaggaaataaagaaattgcatccgtgctacttctcaaaagagtaagaatttaactgataaggttaattattataaaattaacttttaccatctacattaaaattaggaattttctgagaatttgtattctttttgtcctttcaataaagaactcaatatgtttaactctattttaaacaggaatggctgcctatgtcttgcagtttgaatgcaagaccctcaaatgctcaggaattatcaagtaaagtttatgttaagaaactagcattctgttgaatcactcaataatggttattatttaggatatgcaaaagttaatcacaaaaacttagactgaaagatactgcttacaattataggtgggaaataccataaaatacaacctttatttattttggaactcgttttaatgcagaataatcctagcgctctatttagtaacaagaagaaaccaatttaaatatcatgctgatttaaatagtataaataataaaaatgacaattttttgttaattttcagactctacatagctatttttgtctcttctattcttatgaaatattcagggaagatattattactttcactttacaaatgggataactgagaactcaataaattgtataatttatctcaagacacagagctggttcatggtagagctatcatcagaaatctcacgattattagttatccctttccaattctgaagtcctctgggaagtgtcagaatttacactcctcactaggaactactattgcagttggaactctgaggctttatttgggagtttttcctgattacagaaaatctcttcttaagagaggttttaataaacaaaataagtcggggatattaccagatagcccctatatcctcagagctcccagcatcacaccttttataagaacagtatagaaaaacaaagttccttccctcctcctgccctgtgttatttttccaaaaaacaaacaaacaaaaacctaactacacactaagtgtgaaagtgattggagtgggggaaggcaagctggggctgtaccaggtcaagggttgaaaagaattaggggattattacagttctagttcgaagacaaacacttttcaatgtatgtcaatgaactttattgaacagccgccatatactagtaaccctcttaggtgtgttgtacacttacacatcgaaaccagggtttcccagatttcttatgatgaaacagatagaaggtgataatgctggcacagcacacatggacagtgtgacggaaggagaccaattaaggacgangcgggtccgtatttctacacacctgccaccagctggacggctgtgctggaagtctaagccctggatgcttagctgtgtgatctgtgaaccggcagcatcagcgttcccagggtgctggttagaaatacacctctcaggcccacccagaccttctgaatcagaatctgctgtttccaaaattcccaagtgattctcatgcaccttaaagctttagaaacactgttctaattagtgttcttaaaatattgctatgggatacaggctttagtaaattctcaggatattctaccatgtactcaagtttgagaaacaggagatttaataaatactgatgtttggatcccatccatagagattctgttttgattggtgtagggtgtaatctggcattaacatttttaaattgcccctggtgagtttcatgaatggcaatgtttgggaacacctgctttaagttaagccatgagctaattgttcttcatcatattgcagatgtgggaactgagacgttataaggaaatccaatttgcgagtggtagagccagacttaagcttagacccttaactcacttattctcaaaactggtctgtgctgtttattattttacaggagagttctatattgctatgtttaatacattagtatcatttaaatatattttaatatatgcccrtgatggataatactgagtgtccacttgattggattgaaggatgcaaagtattgatgctgttgtgtctttgaaggtgttgccaaaggagatttgagtcagtgggctggaatggcagacacaccctttatctgggtgggcagcaactaaatcagctaccagctcggccgggatataaagaaggcagaaaatcatgatggttaagcaaactaaatatggcctgagaaggactctgtacttctataggtgagtccttgtggatgaactgtaacctagcttaatagtcagacaaaatttaaaacctaatttaatagtatgcactgtaacaatggctgaatgttgcccagtcccagtgggattcaaccactcatagactgcttttgttcaaactgcgttcaaataaggcaaacgccgagctggaaccaatctcactgtttctgtacctcgcttctaattcctgtacgtcactttaccttttttgtctataaatttattctgaccacaaggcacccctggagcctctgtgagtctgctgtggttctggggactgccggattcgcgaatcgttcatttctcagttaaactcctttaaattaattcagctgaagtttttcttttatcaatgaaaagactagactggcttagccttccagcctgcacctttctcccatgctggatgcttcctgcccttgaatatcagactccaagttcttcagttttgggactcagactggcttccttgctcctcagcttgcagatgccctattgtggggtcttgtgttcgtgtgagttaatacttaataccctctcctttatatatacatcctattagttctgtccctctagagaaccctgactaatacaatgtctccattgaaaagaaaagaaaatctattaataaactgatatagtcagagcccctcaagaaaaataccaaagaaactccaatgttgtagagaattattttattgctctaaagacatcaaaataattacatgccttgtttacgatgcttttaagttgatcacattcaaagatgtgtcctatccattcatgtacatacattcaatttcatattgactcttgcctttttcagcagtgatcagtaaaaattatctaaaaatcaatcctgaaggttatactttatttttccattttgaaccttgcccttgaaagatcatttatatattttaaacacatttttaaaaatgaatctccagaagtctaatttctcatgctaaccaaattagagaggttaattcgatgacgaactcttagaaacaatcatcattagaacttgggtattatttcaaacgcatctctcttccaaatcttagcagttgaaacaatttcacaggttaaaccagccagcttgacagcccgtgaatggctactcactaaagggtccaagcagaggcaaaatgatggtcctatctcttaaagacagagcaacagaatatttggaattaaatagaactggacttaaatctcatcccagtggacaactgggaaaacttggaaacattaatcctgctgaatatttgtgcatcatttaataactaatacatactgaattaagtagttagcaggatttacaacactgtgtataaggagcctggcatgtgtttcctgatctttggtgtttttagagttaatattatgacagtgtgtaaacttggtgtcgagaattaaaatttgcttaacagttctagtgttctgtacactgttacctatgttcatcgcctccaactcattgaggctcatgatgctaaggtgaattctggattgaaatctaggtctgtctgcttatagggcctttttccaacttcagggtttcctgcttttgctcaattgatcctttcaaggctccatcacrtttgagctacagcaaatcatggtgtccrctgttcactgatgggctatgttccagaagttgcaagaaaagtaaagggggataaaagaagagagagagagaagacccataaatattctgaagtatatgactaatctagtataatggaagctcagaaaataaattgtatttccaaatatatatttctgaattttttggtatttgttattggtattctctgaagggccactttcttttctttctaatgctctatgtccttacaaaggaatgactattaattcactggaataagaatcacactaattggcacacagtcccaatctgcttggcatgtcatttaatgtgcagccatttacctggtcaagtgaatacttgaaaattaaacagttttcttgtgctatgattgatggcaatgcagtctagggttaagtcttaaacgtaatcccttataggatttcctaggttctccctcagagtttctaactccatagatttgggggtgggtcccagaatttccatttctaacacgttcccaggcgatgctgaagcttctggtccaggtaccacactttgaaaactgctgttttaatgcttacatggggtagcatgagttagttttgcctggggcttttaattccaagttctgctacttaacagctgtgttataatgattaagttatgtgatgtctctgtagcttgatttctttgtataatgaggaaaataatcatwcccttttacataagattattgtgagaatttaataaacaagaaatttcttataatgcctggtacatagtaatcactcaataagttatgtcaattgtcaaagcacatgtctgaattatagatgagagagaaatattgtgaattctatggcactttaatggcctgttctctctacccatctctagccgtaccttacactggcttatcctgtgctcttcctttcctgagggaacccaaccacatatactgcctaaagcactcttttggcacttctaacataggtgcaaggaggaaatttcaagaaattatgacaaactacaagactcaaatctccttttaaattttaaaaatcaaaacatgtattcatatcccatggcacatatggatgaagatattgtttttctcagttaatattttagttttgcttttgtgccagagccttcctttttttttgtaaatgtcccttatcaggctactgcagaattgcacaaatactgaattgccccaaaatatttgcctttaatttgtttctttaaagcaaatgtaaaactacaatgggttatatttacctagaggttttatcaccatacgcttaatttaaactcatataaaaatagaattagttatatttagtcttattttcatcattcacttaatttaatataattcttagtccataacttagatataacaaaaatttgtattttttctatcctccatttgccctaaatctccttaaacaaaacaaaacccaaggaaacawttttgcctggaaaacgtgaagtttgattagttccacctaccttaatgcactttaatttgggccccttctcctcggtagtctagaatataaactttttttttttttttttttaagagatctgtttggaaaacctaccaaaacaagacaaactcaatgatttccttacagagagaagcctggggaaagaattagcaggaatttctcaacgggtgccgctgctactagttttttatgcatgagtgcttgtcatttggcagaaatcaattgttctctttacaccacaagagtggtggaaatgggggtaaaactgcaagttaagactgctctgaatgtggattcaacacttcactgttgtcctccaacatgcgccctcaaagtaccacttggctgggaattaaaaagggttgcctttagcaaagctttaatttaaaatagtcacaggtgacagctctattatttttgcacgytcagatgcagccacagctgtttttattgatctcagctgcatacacacccatttgttgtaattattagtttctgatgtagctgaagatacatatctcgaatgcctatcaaggctaaattaaattaaggaaatcgtacttttcaccttcaccctctttggtcctgctttgctgcaggaaattgccacaatgtaaaactttgagcctcatttcatctccccccactaggagtgatttccaaagttgtcctaggttcctgatctattccaatttaatagttactgacattttttccctgtatatttaacacactacaagcaattaccatgtgrcaattatgaatttaaaaattaaaaaaaacacaattattgctactactgattaaacattgttaggactttgaagaataaaaaagtgaattcaacctgccctcggctttctaaaaattgcctttttgctcttaaaaatgcatgtacagcttttttcatataaaaataatttcgagtttcttctatacgcataaaatattttcagctatttttgatttcaggaagtatgaaaaattaagtatacacaaaagaattgcggcatgacccgttcgaamtctgtctcagtgacagacagttttggattgtagacctcactttgttttgcgtatttctgtttgttgtttcacctgtggtccattcactgtatttgatgtgttgcaaaacaatggcataacggygttcccaccagtaatgtaagaagaaacatggaggaagcaagtaagggtctaggaaatttgggagagaggaaaagagacataattaatgaggagagggatcaagaagattggcaggatttttagaagggaatttgatttgcaaggtacccagaacatggcacacaaaattgtaagaaaaacaaatttttcttgaacatttatataaagattcctttgggaaaatagaacaaatttggttgtagagtggtctggggttgattttaaattggaaaaacacagttttgtttttttttaatttgaaataagagctgatatgcaatattgtaggggagttggttgactttttagtcagaatagtggcttttacaaccatggtgacaacattaactgtggatcctcttgacgtcttcataagttcattaatgctgggggaaaatatgcatagcaactaatctaccaatatttgagagaattaggcaacctctcaagaatgtaggaaagaaatgtaagtcaacaagcttatacaatgtaaaaaccatgaataggcaggtaataaataatagaaattgattttttctgtccagtaaagaccatgaaaagagaaatattataattttaacttgagtgctctagaatactgggtttgtttttttaattgattaatatgattttaaaaaattatcatgaatttaaaaatattttctccattactttgagttatcactttaaacatargtaatatcaagatatgtttctgaattatatatttaattatgaccactaaagagcacccatgaaatggaagtgttaacagcaatgttctgttgtaggaagataatcatattggttatgtctgctttatagtaatgttattgttgattgatttgccttttcctaacttaagtctttttggtcttttcttctatttgttctaagagaccctgttcaaagggacattttattttcctttgtacaacagtatttgcctgacatttactctcctctaataaataatattaaactctagtcctaatacatttacttacctaaggaaatcggccttgtgatggacccccggaggtgagatacatttctggatgaggatctgttgagaagttgagcatttgttcagctactaagtcactgccaccacctcgttagctaaacatactctgtgctcattccttcatcagtaaattttggttgggacacatgrcaggtgataatagaggttattagctgcaatgcttattaaaatatttgaagatatactttagcacattttaataattattgagactgtcccttagtaacagtagctcttctaaatgaaagcttttaaaattgcatgtaagtcaaaacaaagcattatttgttattcaactttatataaaagctgtccagtgatttcaaatatgtactaacatttaatttcaattcaaaataagtatttttatgtttttataaagtgattaaatcactttattgaattctatccctttataaatgaataaaggaatgaactcaagttgtttctattctattagcctttacttttcccttcccccaattaaccccaagcaaaaatgtattgactttgacctgagaagagatacgtcaattttgttatttattttgcctctactcctatttcccatacatatatgggacatatatatcagcacaaattagcaggcccaccaatttcttactcttggatccagtctgatcnnttctaactcgtgaaataaactaccatgcagcacggatgatcattcaaattacagcttagggttgatcataatgtcttcattttagtatcccctttaggttgacattatttattaaaaaggtagttttcaatcggatttatggggcattatcgatagtaagtctacttgatacattgcacatacctttcttctgccaaaaagaagtgtttacaaaaatgtatttgaccaaatactttacggtaaacatcacrgtctgaaagggaactatcttctttgaaaggattaaagcctccagatagatacaaataagatttttttaaagtagacacatgttaaatcatggaacagcaaaggggatactttatggaaatgaattcacaagataataatttgaatttgacaaggtgataattaaagtccccagatagatttcttccacatctgtatgcctttcagtaaagttggttagcatattaactactgctggagaatacagaaaatattcatgggatgtaaaactgcaaattattattcatttcaatttgtataataagtgtaacaaaatgcagtgcatacagtgttacacaagaggtaccaaactccattatagacatttttagagcaaacgtgggatccttatatgacaatttttgtcttcaaatattcaagacatttaagtatgaattaccactttttgcaatttaaaagaaattttgtttatcttcaatgctttctagggctaacaaattcttacttcaaatgactagaatcatttttaaatattatgtactaggatatgtggatatgaacatatatatttatacacaaatatatgtacacagccaaataaacaaataattagtgtaatctatatgtattaatattgntatattttcctccagagaaaaattgaggtttgctgaccagagaagaagaaagcatcaatgtgtgattaaaaaaaaaatgtatatatatatatatccactacatttctaatttgaaatagtgatcctgcatactaattctcttattcataattgagtttcatagtacattcattttaatttagacatttatatgagaaagcatgtttaatatgatgataagaaactgtatgaaattttgggaaagaactgttaagtgtgcccacacactgtaggcactgaatgtcacacttgagaatgtccctggtcctagcttatctataacaggaatattttccrtcatatggaatttaaagataagaaatgaatcaccacgcagagagatgtgctatcacatcccatctatggaaaaaacaaatgaaaaaaaaaaaaacatgaagaaagactttttgaagtgcagcatcacctgcatttatgatattttcagacatataaaacaaatattattctcatggttttgaataaaattgtcacttttaaaatttgacatgggatatcacaatggacaatgcagggacccttcagcccatagtcaacaggtgatcaattgtgaaaactgatattctctattaggaaggttagctagagtaggagataaaaaacaacatgattacaaaaaggaggatcatttgagaccaactttaatgtgaaattgtgtagaaatgggggaaaagatacagaaaacatcttcacaagtccacttgagaaactaagttggtgcaaaagttattgcactaattacttttgcaccaacctaattgtaagttatgcttgaagaaacttaaaaggagagacggagagagtacacaactataaaagcaagtggaacaagaagtgaaaatgaccaaagaacatatttgttgaacatggccattttgacaatcaagggagaatagtaatttaaagtacaatgccacaatctggagaagactgctcttgcacacaagtgaaagytctcatcggtcctgtctgatgcaaattacaggtacattgctgcacaggtgtcagatcgcacatagctgggctggcactgcctctcctctggagaggaatgcagcacattctccacaggcgactggaaagtctggattctgtcatctagaaatacaccttagtwatccccttggcaaattaatgggaaaacaacctcttcacttctgtgttttagaatttctgttttatgccttttcattgtttcatgcaattttattttttcacgaggtcaggcacagctaactgttgattttcaccaaattaccttgttattggcttggctccatggagcagccccttccaagaaagtttcccaagaaactatgtacttcttctacttggactcagctgtgtacctatttctctcgtcagccattagagtgttccactaatatagtcaaagcagaacatctggcctattatataaatgaatattagttttgaagaagatatctttggagacagtagaacaaaatggattttttttcctacacaggaactcttggtttttcctcactgcccattgtcattttttctaccttactcagaacatgattttccctcaactgcacctttctgtaactttgacctgtgccatccttgtgaaataagtgatatgtgatttattttartttctccttctaagtgaacatgcagagtccttcagagaccatctgtgcctcctgctgagtctctgtgttttctacccgggctagcttcctccagagcccagtctcaggtagatctgaaccacacatggaggagattttaagaacaagtcttgtgacacttcctatgctttgggtccaaaaactattgattttcttatttccctgcaagtgtgtcagattctggcaaaactagcttggagtttactgagtttaatgatactgaatgacatcaggactcactcttctcttttcatttttttgctatgagtgggaaaaaatataactgtataagcaatgtactttttttcttaacgcaatttaatctttactaaaattaattttgataatcatatatgtacaaagtgtttaattttgttactttttaattcttagacattgacttttaaaaatcttaatcgttgctattttcacccctgactttatgcccagtgtctatatgcataaacacaaatctttctactcctatctgtttagcaaaatgtaaataaaatgtctttaatttatttcaattttgtgtattttttttaaatttacttgcctgggttgagcatcttttagtatatatttcattgtgttttactgaaaatttgacttaagactcagtgtattactgtcaaactctcccgtcatgactatctcaggtagctgaggtatcactgacagcataagsagcgacaaaccctcgggtaatgcaaattggcatatccgacaaccccaagctaacaagatcataaccagggacttgcaaacatgtttttaggacataaactcrtcttaaggttttacttaaagtascatccatctcatctttaaccagcctctcctaatctttgcagaattgtccattctaatgcagtctttcttcattctttcacccgtggctccattaaaygtttttctgcaggtagcctctccattggagtaactggactgaggatggactcctttcttaagaaatccagaaaagcaacaaaaatctttccagttactactggaaaatttctgcagtcatcatacatgtatcattaggttctcacctaccattcctagagtctatctatctatttacctctgaggtttcttagattagccaaacacttttgcagctctcgtatttgcattgtagggccttggctgagactagatctcccaatatttggatatattgaggactggaagtaaagaaasactgccacttcacacctatggaaatactacctttttccatagaggcagcttgaatacatgattaggaattcactgtgactttggkttagaggaaaaaaamcaaaatgggttatttggttatatagagaaggaaggaaggaaggaaggaaggaaggaaggaaggaaggaagaaaggaaggaaggaaggaagagaaagatcctttctttttccccccaggaacatggcagtttgagaaaatcgggaataaaacawgtcttataatttgttaaatattgtaaaatactttccttattgttagtagaattccatcttggcagactatttcttctaggaaaccatttacccttctccccttctctgggcactrcatttctctttctggtaagaaatctgtcaaaggcacttcaccaggaatctggctcttataaaatgcartaaaactgcaggcaatggggaaatgaccattactgaaactcctttggagasggcttagcttatgaagtttttgagcagttctacctgatgaccagcttactatgctcatctttacttcctcctgtaacaggatgactgacacgtctcctctttgtcatgtgaccttgcagagccttcaggaatttatgtcgactgcacattttccttggccagtggctctggtcttggccattgacttgcatcagtcaacagaaatgttgcagacctaacatgagcagaggctctaagtaaacgtgtgtgatttggattggcctcctgtgcttctgccatttgtcggagcaacattattcatgccgccacaggtccccaaatgagaagatgcatgcagctgatctagacttaagctatagcctagaatcacatccagcccatcccaacagacccagagtgagccgaaatcttcccagcagtttcaagagcagggaatggctgttgttgcaagcctttgggtttcctggttatgtataaagcagcattactcactaaaaacttcataaatacaaagctttctgcatgagtttctattctgtgccctgcaagcttttattaaaggcatgtagagtgaaagtctgattttacctgaattttaggaggtcagggccaaggctggatgcagcctagcagttgtgctgtgccatgggaagggacagcatgtgcccccaaaaaaagtcagaacaaaaaaacccacaaagtttgagtgtggaaaagtgctacaggcttctggaatcagttggctcactgaagttcaagcagcaactatgaaaaagttgtgggacatattagcattttatagggattcttagaaatacctagggagagaaaccccataaaaggctagattttctgccataatacacaaagggacacaggctattggtatttaggcattaaagggaagtttgacccacccctgaaggctgaataagtgtgagacacctggtttatatttatataaatttttgcacaggacaaattcaaccttctaagcacaatgcaaagtagcatatccaatctattaagcaccatgcctcttaactcataataaatagcatatagcaatcctgccacaggcgctaacatttattgagtttttctactgactaggctgcgccaaaatatttttcaggttttaactcatttactgmttcatgagataaattattttactatcttgattaaacaactaagtaaagttttgtttagaagagtttagtagttacaccaaaatccagcagaagaaaatgactgtaatttcctatataacaatcctttgatagtttttctttatcccttctccttacatctgtgactaacacattatacttccttaaaataaggtgggagccagcatttataaaatatatgcatatagagaaaactaacacatacattaaggagaggtggagaaaaaaagaaagatcatatataatcatttatttttatgtycatttatgtaatttatctatgtatataaatgacttacaataaaaatgagtgtattcctagaaataatagacaacagggaattgtattcttggggtgaagtctacaatggatagatggaatagttgtatgaataacatttttgagtatattagcttatcttcaaaatgtgcttggtcttgtcatttagattatattatatccatgtatataaagaataatgatattaatatactcttactgctaaatttatacattactaaaaataaaaagtgtcatatatttgagcctgaggacttatttgaaagtcttacatgaagaatattagaaacatagggattacgtatcttgaggatgaaatctgtataatttctacttcagcaaatcttgaaaagcactctgatatgtcatctattgcctaataatgctgatcatatggaaactggatcaacttgcaaactggatcaacttgcaaactaatattacatgtagtaatattagtttacttcaattatctttcctaactctcaccttgaaagtactccactcattaaactatgcatatacatatatatatatatatatatatatatatatatagagagagagagagagagagagagagagagagagacaggatctagctttgtcacccaggctgaagtacagtggcacaaccttggctcactgaaacatccgcctcctgggttcaagcaattcttctgcctcatcctccccagtagctcagattacaggcatgtgacaccacaccaggctaattttttgtatttttagtagagacggggtttcaccatgttggccacgcttgtcttgaactatggaactcaagtgaaccggcctcctcggcctcccaaagtgctgagattacaggcatgagccatggtgcccggactattcttgtactttgggtgtctttttttttttttttgagtagtcatacagaattataaagtgattcacaccctcttattctaaatgtgttcagtctaaatgyaaaagttttagtataaattaattctgtatatttttatttaattttaagagtggagagatattagctaataaaattagctttggaaataaaaagaacagatacggttatagttcctttccccaaatgttttaaacttacaaaagcaattaagaagcagtatcacaagatttaaagtttttaaggatattattttgttccctaatagactacacaccgtcaatagttaaagttcactaaaaatccagaagttgccacattaggctgaactcacatttattatttctgttattagcttaacttatatttattataggagggatgacttctttttacaatcatttaatatgacaaataatatattacattttgatttaatgacaactttgtgctttatctaaaaggtagcattatttttgtgtgtgaattaatctatgttccaataaaacttccaacataagtaaggctctgtatgtatgttatgttctttctatatctctggattatatggatttacatacttgtatgccagtacatatgtacatatgtttaagtataatatacatgtctgagtataatatatacattcttactgtacaaactatgcatatgcatatccatattgcatgcagctatgtagatagactctgacagcatagaaaaattttaaacttaagcaaagttgaatagctctcaagtactgatatatgtatgtgtccaatattatgattccaccattgctaatgcacacaaaaaaaactaccaatttatttttcttatataattatatctctgataaaattattgtttattcagaaacctaatatcgaccattaatgttccagtttcagaaaacaaaaactcctaagagaatgaatagaaattttcttaaggaattataaagaaccatctcagaattttactctgttactgcaaaatctcatgcaaagataaccaagtacggtatgtgaacgtctcttcttctaaagctcatgaaactgctctctgattcctctagcgttgacaragaatctggagttcagtactccatttcattcctggacatttagcccattattcttgtatccatatttcatattttcctttcatgggggataattgtaagttaaaggtgaatttgttgactcaaaccttataaggaatcatagatcaacctaaagatttcctaaaaatatacctacatattgaatacttgctttgtctaagctgcttaacaacaacagaaaaaaacaagcaaacaaaaactcaaaaacaaaaccaaaccaaatgaaaacctgatggcccaaacttgtaaagtgtattttcttggttaattatttaaataacaaatatgaggaagaaaggcattctagtgaatctgctttaaattacataggagagagtcttatgtaaactaatgataatgaatatgttcggagggtttgtatgtggagggctttgtgttaagcactgtgaatactttgttccatttaaacgccaccttagactctacaaarctgagagagattatgacagttgaccaagattacacaatgagaaagtaagagatagaagtggaacttgatcacaggaagtcacttctaaagactcaacatttgaccctggtctctaacgcattgattttgagcccagcagcatgtgaatttattcctatcaggataaatgaaatgcaagtaacttatttaacttgagtctcagatacatccaaataaaaataaatgccctcatttatagcatcacattctcagtactaagtaagctatctataatgatacaattccattgaggcagaagacttcacttcatatctacacgacatttcattctttctttctatttgttttttctagaagaattaactgaaattcatcccaagatgaggcatcttggctgaggtgagatatgcaaatcatctgtgttgtttgacagtcacgggtagataaatcatatcactaacaaaagtcagttgttaaaacttgaagcacatttaataaaaagagagattctcccagtcacacaggccaggtgggtgcatagaaatggcattttatcacttactgaccagagagttgcaaatacaatcccatcacctaaaaacaaggaaacaaaacaataataagaaaacttttttttttaatttttaatagaaagtcagttttgcttctgagtaggtattgtaaaataaacttatgggttcttttaactttttttgctttaccttactagacactgagttattattttttgaaggaaagtgaattataaatcagaaattattttctctttttgttaataaccttaggacataagaaatacatatttccagaggaatttatagaaaaaataaaagtaatgcttccattattagtattctccctaaaactatagttagaaattataaaagtagggaagggtccatcaatagtattgattgaaaatgtaatgttacatgtatcagatacataaatccataaatccataacaatggcaaagggagacatcattactatttggataaattaatatacttgaatattttcccacataaattcactaactattcaaaaaacttcacaggacttttgaatttccgttgtttgttttactgattatgacagctcacaaagcagtatgtgtaactttcaataataatttagtgatgaaatattaccaaacaagaggagaggattttgattacctatggtattagtttatatcattgtgtaacaaatcttcataaaaatataattcataaaaattatatttcataaaaatattcataaaaatataattttataaaacatattaccacgtgttatcagctgggtcccagacacagagtccgtcagagtccagtgaagatgttggccagactacattgtcatcagaaggattggctgggaagaatctgcttccaaactcattcagctttggtagaagttatttccttgtggttgcatgactggtctttttgctggttgtagttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggtaacctcatcaccggagtcaagtgtcatcacctttcccatgttccattggttagaagtcccagctcctgcccacattcaagggtaaggggttatacaaatgtgtgaccaccaagaagtcaagattatgtgggtcacttagggtctaactgccacaactacatatttggatataatttcaaagaaagactgtgaaaaagcataaagaattgtaggaattgcctgagaattgaggacgttcatctgcaatgcctgtcaggcttacattaaacaagtctagcttactgagaaagttttaaaaaatgggtttgtatgactttacttattgggagaagccatttgacttgtctttgaggggaaaaataatttaaaaatacagatatactctctctgcaaaacaattcctggaatatgatctaacagaaaagcccagcagacctgattcaaacctgatgtgaacacagaatgctttgaaatgagtaaatttaattattaaacctaatttttcaggtgaggaaactgaaacactggggttaagtatcttttgcagggtcacacagctaaagaattttggagcaggaattcaaattcaggcagctggcttcagacctcatgctattaaacctgatattaaacttgacatccatcttacatgcaaatgttactctctctatcaggaaaataacgcatttataaaagccagctcagatgttacttccaaccaacaaatttcctggacacactaagtaatagagttaatcacaccgtcctgtaagtactacccacagtatccgggctctaccacattgtaatgcaataggtgtgttcacactgtttgtctctcctggtgaatcgttaattcatcagagcatgactgtgttgtgtgtcccattatccttagtaaataatgtagtgccttgtgcataggaagaaattaatcttgatggctttcaagttccaccccaaacagtcaagccatgttgattgaaaagtatcttctcagtttgagagattaccatcagagtatttgaaacaagattgtatccttggggactccatattgaggacattttcttcataggattctaaggtctaatgacttggcctgatcctaacctaatcctttagaaggctagagaataaaattaaatatgtttttcacttttccagtggagtaagcagggttttattgtgcttcttgaatcattgtcacactagtaatctcttcaaaagcgaatttgttctggaaaataatgggttagaggcctctgtggaggaatacagtagtggaatattttgaaataattgtaaagcaaaacagataattgcgtttttaagctctttgaaatatatacgtaagatgttatgtgcctgaggttgaacaaaaagataaatagttacagtcattacccaataatgtaccaattacaaatagcattgtgtgtacatgtcctctattataaaatcagaacgggatgaaaaagattataatcacgttaataatttgatttgcttcattcatcttttgagttatcttttcataaaattagatactgtgttatttccttctggaaagtacaatggtgcatgtgaggagaatgttttcatgttaatcaatgctgacaagaatattacacttaaaaaacacagaaggcaggcaggttgggggttggaggacagacaaatgaagaagaccagattgaaattattagttgccagaaatatatctattgactttttacatttttagaagtacctctgttagcttcccaaaatacagctgtttacagtgattgataagttcccgtgcttttaagcttattcacatccattagttctgcctttttcccctgttaaaaatctgaagctgtcacattgaagtagcatgatcagctaatgttcctgccagattcaaagcatgtccccaggggtggcaaaagtattcaaaatctcaaagaaatggctttttaaatgttgcctgttgacattggtcactccatttgctgtatcagaaatgttgaaataaatatcaggcaattatagaaacaggactttgatgatcaattttctataaatattttatgtttagcccaaacaaaagaaggcatttggaattcactattttgtataaaacttttattttaaaatagtatgtagtatattttcaaaattggttaattaattttctagttttcacttcaaataatgattatttactctattccctctagcattagattattttcttgcaaaccgttttttttttttctttttttctttttcctgtaatagttttagagtttctgccttaacacatttaggtatattttgtaggaacaaagggaaaaggtatcagggagaggaaatgatttctaaaatgtaaattccaaagacagggaatgttaaaagtgtttgccagtcctgtttcttacagagcacagaactcagatgctcttataaagatacaggataaatcacatcatttcctgctccatcatcagaatattattatatgatttagatcacttttttaaaaaagaacatggmcttagtacagaacaacagcaaaagcctggggaaggagaggagtgcaccatgaggagtcaatggggagcagaagccagtccatttgactgatttggttcgtgtgcaaaataattgctaaataattgcatatatgtgagactccgggtattttcaaaaccagctggcaaaattgtgttattctctaccctctgctggctttcacgggttctctgttctctctccttttcctccattctcctcttaccctaattcctgaccactgtaatccaataatctaaggttttaggatttggatgactaaggttacccatggaattgtttggaaatgtagacctgtaatggagaggggagaaaatgaagaaatagaagctgtacgaaaatagtcaatactgaggccaggtaccgtggctcatgcctgtaatctcagcactatgggatgccgaagtgggcagatcactggaggtcaggagtttgagaccagctgggccaacatggtgaaacctcatctttagtaaaaaatacaaaaattatccaggcttggttgtggatgcctgtaatcccagctactcgggaggctggggcaggagaatcgcttgaacctgggaggcagaggttgcagtgagccgagattgcgccattgcactccagcctgggcaacaagagtgaaactctgtctcaaaagaaaaaaaaaaaaagaaagaaagaaaatagtcgatactgagacctggaaactgagagcgttcatgaatgctgcatccaaagaatattttgtactacgtcttattcatgatacaaatcaagcaaataagcacactctgttgttcacatatgacactatataggtcaacggggtgagagagccacccagaaacagacacacaattttgttatcagatattctggagaggtttctctgaggcagtggcatctgaagaatatacagatgttaaccaaatgaagcaggtgggtttggggaaaaaagtattccaaggagaggggcagggtgtaggacaactaaagagcaagggtgattagaatactttgatgaagtgaaaaaaacactccaatgagtgagcgcgtatgaagaaaagggtggagagcagattattgaggtccatttagatcatgttttagatcctggacagcatccttaaaataataaggagccactaaaagtttgaagaagggcaatgacatgttccaatttgcttttttacaagatcactctgacttctgcctggagtagcatataaagggactaagcacgataccaggtggcacataggagctgaagtrgctcttgtcaaaataaggtgatggggatgggagtggatttgtttcctaggctgctacaacagagaactgtgaatggagtagcttaaaataacagaaatctattctgtcccagtttgggatggaggtttcagcaggacatgctctctctaaagactttaggggaaaatctgttcaatgtccttctcttagcttccagtgttgctggcaatccatggagctccttgcttgttggaatatcactccatcatcacggtgttcttcctgtatgtcttcaccttctcttctccgtgtatgtctgcctctgtacctcttctcctcttccaacaaggaccccagtcataatggaatagagccactctaatgacctcattttaactgattacatctgcaaatatcctatttctaaataaggtcatattcataggtattgcagattaagactgcaatatatctttcttggggatatagtttaaccccaaacaggggattattgaaaggaagtgagataagggttagtggaaagaaaccatgtaaaggttttaaaatatatttttggtggtagactcaacaggacttcatgattaagtctgagtttagggatggaagcagagtcgtggttgacttccaggtttcttccagatgatgatgccatttgttgagacacaaaatccaacggatcaagtaagtggtgggttgagcatgggttcatttttttgacatgccaagtttgatctgtctgtgaaatttttatgtggagctgtagatttggtggttaaaaatgcctttggaattcaaatgagagatttgagttggagagataagtgtgggagtcatttctattcaaattatcatcaaagctatgcaagtagataactttcctcaaccagataatgtttagtcagaagagaagaaaccttgacatcaacattaaacattttaaagaacaatgtggactatttcagactaatatgaacaaaaaggaccagactaaccctgccataagaaaaaacaaaccgtcaagaaacagacaggacatttgaaacgatggttttagagacaaaaaacatcaggcagccaaggacagaaaaataagcaaatacattgatcccaacaattgcctgagattacctaagttcaggtaaaagacaatattgtctgctttcaatatttctatttaatttgatattgaaatttgcattcatagtagtaagacagcaataaataaaaggcatccaaattgtataggaggaaataaactggttttatctgtagacaatatcataaactatataaataactatgaaacatacaaaaaggtataagagctaatgcatgattttagtgaggtttcaaaattcaaatttaatatataacattaaaatcacttgatacaagagcaaagaacaatatgtaattgaattttaaaaaattgtacttataatagcaaaaaatataaaatatttccagataaatctgacaaaatttgtgaaagtttcacacagttaaaaatagaaaacactaaggaaaaattaatgattacctaaataaatgcagaaagatacatttttaatgggttggaagataatattcttaagatgtcagttgtccccaaattcatctatagcttccctgttatcccagcaagctacattgtggaaattgacaagctgaatttaaaattcctatgtaaacgcaaaagaattgttacagctgtaacacttttctaaaagaacaaaactgggaataagtatatttttaagacagttattagcattaagatagacaaatcaataggataaaatagaaagtaaaaaaaaaatagacctatacatatatggacaactgattttggccaaggggcaaaggaaacttgttgggagaatagcaatatcatattttcaacaaatgatgttggaacatctgggtattcattacaaaacggttaatctttgatccatatttaaaatttaactcaagttgaattatagatgttggtgtaaaatctttaactataaaattcatggaagaaaacatatgagactaacagtgtcaattagcgttaagtaaagatgtattagatgcaacagaacaaaacatgatccatgcaagaataaatgtgataaactggacttcataaaaattaaacaatcgcaacaacaaaaaataacaaagaaatgaaaaagagcttctgctctttaaaaatcattattaagaaaattaaaagacaattctccatggtacacaagaaaagatttacaaaggttatatctaatataagatttgtatccagaaagtataaagaaacctcaatgttcaataagagaaaaaaaataaaaatgagcaaaagctttagcagaccactgaaaaaaaatgggtagagaatatgcatatgaraagatgctcaatatcattagtcattaggaaaatgcaaatgaaagcataacaagatagcactgccctcttttttaaaagtctaaaactaaaaatgctgaccatatcaagtgttggtgagaatatggagaaactagaacactcatatcctgtctgtaggaatgcaaaatggttaaattactttgaaaaacaataatgaagcagattccttaaataaagggtgatctatccaactactattagatctattcaattgatctaggtatttacccatggaagtaaaagcatatcttcattataagacttctacacaaattatcacatctttacttacagcagctgaaacctggaaacaactctaatgcccgtcaacagaggaatggatggataaagaaactgtgatgcagtggaatacgactcaacgaagatgagactaaaaataattatactgagtaaaagaatccaaacaaaatagagcaaacactgtgccatcctgtttataccttactccagtaaatgcaaactaatacacaatgaaaaaaattacttatttgagaactggggagaggaaggagagggaaaggggtagataaagaaaagaggagagattaaaaggagcataagaaaacctcagagaataataggtttgtggtaaacattaccgtggtaatgtttttagggtatattcacatgtaaaaacttatccaattatacattttaaatatgtacagtttagtgtgtcagttatgcctctgtaaagttgattttaaaaaaagttcctatttccaagttcacaatttcatttgaactcttaaaaactggccaggagcagtggctcatgcctgtaatcccagcactttgaggagcagaagcaggcagatcacgaggttaggagtttgacaccagcctgaacaacatggtgaaaccctgtctctactaaaaatacaaaaagtagccagacgtggtggtgggcacctgtaattccwgttccaggaggctgaggcaggagaattgcttgtacctgggaggcggaggttgcagtgagccgtgatcgcaccactgcactccagcttgggtgacagagtgagactccatctcaaagaaaaaaaaaaaaaaaaacttacaccaaggtcaaagcagaggagctggcaaaagagactgagaaaaagagcagagtgatagagaataagaaatgagagctcccacggaagctaagggcaggaaccacacagtccttcctcatgctacttagaagttaaaaaaaaaaatgagagttaaaaaaggccattcgtttcagaagtaacattatggactaatgaaaaggaatttagttaaataaggcatgagacaaaagaaagtaggttgactgagaaatgatgaaatagaggtagcaagtaatatggtttggctgtgtccctacccatatctcatcttgaattgtagtttccacaatcccacgtatcatgggagggaccctgggaggtaactgaatcatgggggcaggtctttcctgtgctgttcttgtgatagtgaataagtctcatgagatctaatggttttataarggggaatttttctacacaggctctctctcttgactgctgccatataagtccctttgctcttccttcatcttctgccataattgtaaggccttctcagccatgtggaaatgtgagtcaattaaacctctttcctttgtctcaggtatgtctttattagcagtgtgagaacagactaatacagcaagtataaaaaacattaaatgtttgtcttctaagggaagagaggagagtagagagagagagattgttagctgaagggtaaagtattcttgttattaagatatcagagcctagaacatatttaaatactgatgagaaggatacaagggagagagaaaatttgaatcaatagtttgtttccactaccacagaaaaggatgagatccagaggtttgatagaggaatgagttttcctcattggagagataagagcagatgggtttgaatgctggatcctaagggtgggatattaagggagtctgttttttatggcttttattttctctttgatcttggcagcaaggatgtctgccaagatttaagggtttggacaggaggatcatagttttaatgaataaaaacatatatgaaatagccacttcagagagtggggcagacagtatgtgttttagtttagaccagagtccctggagttataggggtttgaattcaaatcctagctcctccattcacctgtggtactgtgaacaatgacagaaccaagttaagaccccaaatcttctttaaagtgggatgataatggcatgttcaccatagacttcttgggagtaataaatgaaatactttagttcaactattttcacaggtcctgacactgggttttgaataaattgtgcccaggactattgctattataaagcaaaatgaaaaaacacaatggcccaattaatatgtttccaaggagttcaatactaagaagaaaagtattgttggaaatggaaatccacattactagattaacatgtggagaacttgctcaaagaggaggctggtttagatgctgtgataattttagatgtcaaatggactggattatggaaatacccagagaactggtaaagcatcatttttggtgtttctgcgaggatgtttccagaagactttggcatctgcgtcagtggactgagtgaggaagatccctccttaccgtgggcaggtgccgtctcatcagctgatggcccagatggaataagatagaggaaggaatatgtgtttctctccttcttagggctggaacttactcttcattccctgctcttggacaacagaactccactttttggactctaggtattacactagcaccccacttcccatagccgagttcttactccttagatcttggtctgagagttacaccattggcttccagggccacactactccatgccaggatctccagcttgcagatggcttgtctggaggcttttcagtctctataatcacgagccaattctcctaacaaatgctatctatctatctatctatctatctatctatctatctatctatctatgtatctatccatccatccatccatctatgtatctattatctatatctatcctattggttctatctgtctggagaaccctaatacagatgccagcaaaccaaaaccaagtggcaaatgtctaccattgacattcctctccttccttaatgactcttagtaaccaaaaacacatgtaaaattccatgtaatacacaagccagaaaaggtaaaatattgtatctgctagttcacacagctcatttcactaccacaatctaccattattcaaatactgatttagaaaatgacagcctccaaaagactaaaatcatcagtttttacttagaagaaaaagaaatgaaattttaatgacagggaattttaatcttactatttcaatttataagatgtgactggctgaatattgttatgtactaaaatgataaatactatgtgttattaaatattttgtcattgaaaaatgacctattattctgacctattttattttcaggggtacttttagataaaggagtttataaaggcttctgctaaagaagacatcagagaaaatgtcttccaattgatttatcttgctttgtttctgagcatcttgactccaactgtattgcaatgaaaaataatttttttaaatggcagagactctgatttgtcctaggccccttcttctaaattccaagagtctatgtgaactctttctatgagtttcttaaaattcacgaaagtagtctctactggtttaaatggtgtcccctcaaaatttatgtcatttccagaaccccagaatgtgcccttatttggaaatagggtcattgtggatgtacttagttaagatgaggtaatactagagtagagtgggctctacatccaatattgctggtgtctttctaggaagaggagcagagccacagggaatggtgaccatgtgaagacagaggtagagattgactgatgtgcctgtcagccaaggaaggtggcgcattgccggccaccatcaggaagtcggagagaagcctggcacagattctctgtccagtgggaaccagcctgtgtgttaatttcagacttctaccctccagaactatgagacaataaattgcctaaaactgttttaagccactcagtttgcaatagtgtattatgtcagccctaaaaagctaatacaaagccctagagaatttcaataaaggtgtcaggaaatatagatcacagacaataatgataggaccttctagcattcttacacttctgtaatgtttgttgctctttcggtctctcctatatgcttttattgtgattggcaaaaatcccttgaaaaaaccaagaaacaatacgaacagaaacaaagctatgtacttgttttgggaagcaacctcaaatggaaagatgggggctgtgttctaaaaggtgaggagaaatttatagcgaagataaagagataaagataaatggtcctgtgcaccactgaattctgagaactctgaacaaaacctaagtatatgttagtgcccagtgaatagttgttgaatgaatggatgaatcaacaaataaatgaattgatgagataatcaatctgtgagacaaaaagcaacacaaatgagtagacaagagtgggttagtttggctaaaaattgaagatcacccattttttcagccaagtaggcaggcatctgctacttgccaggcatgggtattggtgtttggcataatgaaatagcaaaacaaagtcctactgtcaaggaacatagactcttggaatttagaagaaggggcatgggacaaatcagagtctccgccattaaaaaaaaattatttttaattgcaatacagttggagtcaagatgctcagaaataaagcaagataaatcaattggtttaaaatatctttcacactacccttccatggaaggtgcagagaaggttccagtctaaatgtaggcaactggagactcccttttcctatattcctttaaaccctatgccccaaaatgtgtaatcaagtctattcttgaacagaaaagaacacagtgccctttctctttggaattttatataagcccctaagaaaagctgctattgtcctagtttgtaaaagtacaaatgggtgagtatgcatctgctctgttcagttggaaaattagtacaggtttcagcactcctcgataccaattgactattgaatgcgtactaagggaagcttctgtacagaccagtaaaccacacaattgcagaaatcctctaattaaagaaacacaccataatcttcctggtgaatctgaagaaaaggttttttagaaaagtacatctgtataaggtacatttgtgtaaaaaacaatcatttttcattgaagtgcagctgtattgttagatgttgttctaagaaaactcagcttaaaatttcttataggctgctttggcttaaaataattgcctaactggatggtcacaaatgaccaagaaaccaaatatatttcatagtattaactatcattacagagtgttaaataatactgcacagtagagatcttttgaaaaatattttaaatgatagattctattttggtttgaggcaaagtcttaaacataacaagttaaataaatttttaatgaaattttacaagtgaaataattaatgttcaagacatagaatcatgccttttggaaatgactctcatgatattctattattttaaaaactatgtgcctatttttaggaattaaattgctctggtagatacccgataaatatctatctcacaaatcatgtttttctgtcatatgtaaattttttaaatgttttagtttataggttgtttggctctgtcacccaggctggacagcagtgctgtgatctcggctcactgaatactctcctttctgggttcaagggatcctccctcctcagcttcccaagaagctgggactacaggcatgcaccaacatatctggctaatttttaaattctttgtagagatggcatctaggtttccctggttggtcttgaactcctgggctcaagcagttcccctactttggccttccaaagtatgggattacaagcatgagccactatgcctggttagtttctaatttttacattcagtttatttttatgtgactggcatttgtgtaggattatttttataaccaatatgttttaggtatgtaacccagaagtaaatcactaattaatctgcaccggaggaagtataatttagggagagtagaaactctatctgatagactgcactgcaggtaaggtgtcacagccttgaagcgcctcagtgactttgggaaaaacaagcaccaagactgaccttccagatccaaggtctggtagcaggatggttttcatttccatctgttggaggtctcagcttctgacataaaggcctgctttatacaaaatgagcctgattgaaagatgtaagccaccaggttagagggagaactacaggaggcagacaggagaaagtaagagaagagtgacgttgttcttccactagcttgtggctactaacaaatttcatcagaaagttgctgaggattcctcagaacaatttacagagataactgtaagctgcagagggctatgaaaacgctcatgggtgctgacaggagcccctggtgggtggtgggttgggaatacaggggctctgtagggggtgaaggaactgtgcttgacaccaatcaatgggagcctggagaaactgaggcagggactggaatcgtgctgagactcaaacgttttgagttagagtactcaccaggtactctaactcaatcatatgccttgggtataaggaaattaggaataattggaactgtggctggccccaaatttcatgccctatttatagccattcatcaaatttagaatgaggtaaaggaaggattctttttattattttttaaaatacccacctcattttttacacccacatcataaatcaccgagagggagaattaggcctgtggacctccctttttgtagtacctcatatgtaatttttttttttttttttacagattcatgttttttggtacaagtgaacgttttataacraaaaggcttttttgttgttgtttttattctctataaaaatacctctgggtgaaaattgttaagaaagctaattattgtatctttacatgactctaaatttggtctatttaaaaagtcaaaacatagacatttggaaatgactttctcctttcagtactgaagttgagagggagaaggaaaaaaagtgagaaattccagtgcctggatgttcccaggctaatttctagacaagtgagttttgataagttcaagtttcagatgagaatttcttttttcttctctcattggttttcccacatcgtgagttaaaatgtctctgaaagagtctgaaaaaatatatatattaatgtggagaattatttacataaaattttaataaactaatatgagaatgagaccctccaataaatattgtttagagttattttaatagtcctctcccctatcataacccatttaaaaatgtgggtatatatatatgtgtgtgcattcataaaaatttagtgtgcagttcttagtttttctttatgcaaaacacacaaaataaatgtgaataattgaagccattacacagacatttttcctgctaagttctgtaaatagatattccaataaagacactaccaacatcttactttgtcttaaatataattgagagtatttccatattaaacgttttaaataaaaatgattggatttcaaattgccttaaagattcataatgtaatattcttcaccctaaatcacccagattatttctaattgtttctttattttgccttcataaatacagcctttgattaatttagcggaatttatcaatctgagatatttttaccttcccacattacagcatgccatggaatgaaaacttactttgttgctcaaatgtatcaaacacagtttctgtggtcaagttcctctccttttctaaatttgcttagaggatctcataaaacgtaactcctctgacaagggaaccattttagcaccaacactgcaaaagcttctgtgttcctaagggaaagatcctttcctgaattaaatttaacctctttagtactcccatttagccacctgataaatccacttgagctatcttttgggaagagagaggtatctgggaacaataacacttcctttttgaacagtttaataaagctttgtgagatttcaagatgaaagataatgtgtaatgctgatagtgccctccaaggctctgcattcatggatccaattacgttttttgtcatggtaaaagccacagtggatatattaaatragagtgtggtttaagaatgaaggcccaggagtctggagatctggtttctaaggctgacttcacttctgctttcttatctcactaggggtatgcagcttaacatctttacctcagtgtctccttccataaagtgcccagcaaatatctgagaaattcttttaaaatgacagtgcaaattgccatttagaatcaccttggaatgtctagaaaaaaatgaggtgaatgttcgttcagaacgggaaatacaatcttctgcttaatttcagatttatcatcaagtttgtcttttactttttaaaagtcatgagatttccagaagaggaatgacattttcaaagccttaaggacacttgtgaaaacactccttcaactattctttatttctcaccaaaattttgactctggcttttctccaacttcctctcttccccaattcccaattccaacttgaaaagagtaattgcaatcttaactttttccattctggagtattttcttgcagccgatttgtttcatataattgtaaatttatgcatgtcagattttgttttagatgcacgtttgctggctttagtcagtcaatccccaaacccttaaactgattaatttcaccgtgaaataattgattacgaatttgtagcattatctgactttattttaaaatgcaagttgatagaacattgtcatttattgattaatctattgccctttgccttgagataattttgaagaagcagaatagtgccattagtaagacaatatctatgtattacaaatgatcatgttcttaaaatacacacgcacacacacacgcgcatgcacacactcacactttctagtaataagcagtgttttgagtaaaatcttttgaaagatgtttagcaaatcgaaacaatttctgtcttcctatgtgatgcctgcaattatatggtttagatatttattgaaggacttgggaaacctcatagtcccattggcattattctcaacatatcaaagattcattcagtataaataaataatttcattacttataataataaaagttatcatggaaaattttataacctagtaaataggatgtcatagaaatattcaacacggataaataaaatatatacatagtttaaattagaacacctgttatagaatggtacagtctaactctctggccaggtaagcttctagcatgaaacttcacacaatcatacctacaatatgttcttgcctaattccttgttccaaaggaaagtttgataaggaagttgaataatttagcttccttttagagatggtagagcttatttaagtagctttcctgtagtacaaaaagattaggcagctctgattggaactctagattgaaaatgagtagaaataacctcttatagaacacgtctaaatttaactttgcttcacaccgataaactatagcctctactactttatagacagattatagctcatcagtaggactaaaaatcactgtggaattactctgcaatagtcctgttgctatgtctataaatataatttcagtgagtgacttttccattttctagctgcttggctatactttttttgcgtggcaaactaaagggctttaggaatatggtaaatgacaaatttaaatagcctcagataaaacatgaaagtcaacattaaattatttggttaaacattattttcagaacaattttaaaaaataatattttgcaactgattttaacttaatgtttatactattctaaaaaggtaaaaaaaatgcaatgttgtttattctcgttaagcctaacatgaaaataaaagcattatttaggggaaaaagtcccatttaattatgtgaacacataattaaataattatcataagaggcaaaaaaagatagatagcatcagatattgtagcttggtagagcttcagtactagggggtcaaacagttgaaaataatctgggaaacagttttaagtgttttatatttaaaacacctacacacacaaacacacacacacacacacacacactctcacgtaggcagtgtgaaatttacattgttcctttcccatgttattgttgtgtatgggcaggcttatttttcacatatttccctctcaatagccttggggttctaaagagagacacaacattatcacccaagatgcttgacaaagatgggtattttgagggtgatccagatttactgatgatatgaggcctggaaatctgaaaatttaacaaactttcctagtaatttttataaaaaacaaaattcaagaaaaactactgcatgaaaaaatgtgaagaagccagtggatacttttaaaaaagtgttaaaatggttcctatgtaatagacaaataatctctgagctagataaaagttcaacatgaagtataatctaatattaaaaagcccagagaagttgctttcgtaagttccaacattagcatttagctttctcctggttaaaagtttaaaatgaagaagatacatactctgcatagggctgaggaaggtaagagacccaaggacataatgatctctgtaaatgcctctgtgccatttccaaatagccgtcctcatgccttctcttccatccttctttccttgttaccgtctctcttccttcttctgtctcctttgctgcaacagtatttaagtggatatataatacatattaactctatcacatcttttaacatacatgttggtttaatgactgtggagcgattgtaggaattgtccattttacttaatttttcagaggtttttggttaagacaaaattccctcagagactcaaatgtcatctgttgattgaaatatacatctgtgttttgagattaagcccaaacgaagggtggcttctctctctggatcggactatactttgagtcatttagttacagtaaaacaaaaatatcaaaatggcacgaaaaaattaactgtggtgcctaattctttgttcctcatgaaatggattgcctataccatacttaaataacatgtgcatagcctttccaaagctccaaacctcacgatgaaatagtcctctcgtcccttccctgtgtgagtgttgggaagattccttttccctgtcaaggggcctttcctccggtgttgaccacaaggtagttttttgaggggatcttaagttgtattagtattttatgagttcttagatagggttaaataattcctcttactttggcgtggaaagagaatggagtgtgatagtgaatgtgggaaaaagttgtgaaagactgtgaaatgagctgtaaagattactaaatcacctgactagcagagtcttccaagatttctctgcctttcatcatctttgagctattttgcaactttgtaaaattttaaaaatatgatataaatgcaattgactttcttccagaaaaatgcaaagagagtgtccagtgaaaatgctaaggattattgctctgtgaatcgaccagttttacctgtagatgattttaaatttgcctttgaattggttgtaacatcttattgtttctcttattaatcaagtaaaatctttgattcatgttcatgatacatctgtatgagcttaccatgtctttaaatgccttatcatgttaacataacctactttctagacaaatagsactccctttcttattttcaagtaagtagcaaacacttatttgaaattctgagcccatcaatttattttttatatgaaaggatgaacatttcctagaagccctcttggtatcatctaggtaaacttcatatcaaatctgtgctaatatgttatttgtcctggaactggttcttagtccaaattttataccatttattcgactcttatatccttcaccttgatcaatataaagtgcatttgccacacattcggtttgaccaatattattctctgtatagtggctttaactcaattatcaaactgtattttaaaaattgaatggccaggtgtggtggctcacatcttctataatcccagcactttgggaggccaaggggggcggatcacctgaggtcaggagttggagaccagcctggccaacatggtgaaaccctgtctctactaagaatacaaaaaaattggccgggcacggtggctcatgcctgtaatcccagcattttgggaggccgaggcgggcggatcacaaggtcaggagatcaagaccatcatggctaacacgatgaaaccccatctgtactaaaaacaaaaaattagccaggcttggtggtgggcgcctgtagtcccagctactcgggaggttgaggcaggagaatggcatgaacccgggaggcggagcttgcagtgagctgagatcgtgtcactgcactcgagcctgggccacagagcgtgccatcaaaaaagaaaaaagaaaaaagaaaagaaaacaaattagctagttgtggtggtgtgtgcctgtagtctcagctgcttgggaggctgaggcaggagaattgcttgaacccaggacgcagaggttgcagtgagcccagatggcaccactgcactccagcctgggcaacggagcaagactctgtctcaaaataatttaaaataaacaaataaataaaaatagaatattttggttgggtgtacatgggtgagctgctttattttatgtatgtagaatttctaaaataattgtgcttttaccgtctagcttctataatttataaatatgtaataaatagtagataatgttaatgagtgtgttgtttggcattttgttagttggcttaaaaatgagaatgataaaaaaggcatggtatcagggcattttaaaattattagccatgggggtaaaaaagaaaaaggaaagtgagacaagttgccagcatggctacacagagaaattccagtttccccaaaactggaaaagaatagcattttatatgaggacagtgtgcttaatacataacaaagatagctgctatatattagaaattatgtttgttattccttaagcagttatttttaatcttgatagtttattctggttagatatataacaagaatataactctagtctcttcttgcaaaaaaaaaaaaaaattccaatgagcaagatgattaatccagtaaagaaacatgtccagcctggggacaaaaaaaaagtagatcaaattttggttaggaagattaaccaagtaaaaatccattagctggaatttattgtaaaagccaataagaaatcatccaagaaataaaaaactaaaaatagccctcaatatggaataaaaaaagacatagagtgattctctttgcattcaatagagactgagaaaacacaactgtcagaatattaaatattgctttggaaagtttggaaatatgatgaaagtaaattagacaattgctagaaaaatatccttcagttggttccccacacatcacaaaattcagcttgataccattttctttttcttgacaaatttagggcttttattagtgctatgacagaaagaaggaatgctaccaaaaagaccatttgaatttactttaattatttcagagtagggaaacgataattggaaagtagtttataaccttgagtttgtaaaatctgtaaactctcacaacgatgtgaaggcagagaaagtatcaaactcagtcccctataataagctcattacttcataaaatatatatccccttcatctatgtgtcagaaatgtttaaaattttcaccactggtacattatttttgggccttacatttttgtggatttggtgaatacctgaaagaaataaaataggattggataatgtgaatttcttttacactcattgtcattattagaaaataaagcccaaataaaatatgacagagcagaattagttttaatacaggaaaaatttgcaagttgaagaggagaaaatgcagccaggaactaacggtacacacctaggtggttaagacagtgtggatggtgataagagaacataaggaaaattctgccctccagctactttgaatttagtgttctgcctagtatgaatattattgaaccctatggtatggtacttaactatctaatgagatgataactctctcctacctgtagaaaatgtagatgccttgtctacttctgcttatatacatgctgaaacatactgatgtctgctgtcttcttaattttacactaatttttaaagtaaagattgatttgataaaaaatatgcacttggaaaaattattctgctattcccacatttcatgttcatgtctatttacagctaacaagactagcacgcaaatagatatatgctccaagatctcgcttcttttcatgtctggcttctccctgtttacccacaattattttcataatattttactgtgattccacaaaccagagacaaatctctgaagggaatagtgttccaaggcatggccatcattagaagacaataagcttgttttccttccaacattcttagctttgttgaaggctaagtggaagaaattaacatactgcatgcctttcaatgaaaattgtttctaattattttgcttctcaaattattccaccaggcattgattagactttttaaattcatttcatatctgtcactctcagctaacatttgtaattttttaattgttgttaaagagaatctattaattgaaatataattatcctctttaataaaagtaaataaaattacttgggtagccaacatattcaagtaatcatcaatcttggtcagaaattaaaagtaagatgagcatctaaacttggcactcaaagactgaccatctgcacctttgaggcaaaataaaattcagtttaggaaaaccttatgaaaatcaatgttttaattatgctatcaagggctgtggtaggcagaaacttctttgctccaccccccaaaaatgtccagttcttaatcctgaaaacctgtggaatcttgtgtaacaaagggacttcatagatgtaattaatgttaacgaccgggaggtggagagtgacctcggttatcctggtgggtccaaggtagtcacaggcatctttataatcagtgaaggtctccctgctgtgcttagagagggggatgctggaagaagagtggtcagagaagcaacattgctgactcyaaagacagagggcaggccacgagccaaggcatgcaggaggcctccagaagctggggcaggcaagagaatggactcagccctggagcctccagaaggcatgcagccctgcccattccttgcttttagccaggtaagatgtctgtcagcctgatgagaactatgaaataatgaatgtgcttgtttttttcaccactaaatttgtgcttatttgttatagcagtgatagaaaactaagacaaggctatatcttggcatgtcagattttaagttatctgctatagtttagaaaagcccanagaaggagctgcaatttgtctctttgaaaaaaaaaaaaaaaaaaaggatcaccttctaggggattaaacattaatgggctgggtgttgtggctgacacctgtaatcctagcacttggggaggccgaggcgctgctgcactccagcctgggcaacatagtgagaccctgtctccagaaaaaaaaaaaaaaaagaaaaagaattaaacgttgacagattattaagtgaggcactgtgtgagacctagcttgggtttgcgcctatagatatttaaaagttgatccaggttttcacttgaaagcagaactactgccttaaattcccacttcacaaaaataaatcatggattgagggaaaaatttacttgtttgctttataaaaagagatatcgatctcttcataagttatatatgttttacaaggttgcactgtttgaactgtaagtgtgaatggttgctaacactccagaaaccaagaggtacattttaactggaaaaattttcttcctgtatcttacaaattaattgaagtttgtctacgcttgaaaatatgtcaaaagtattatgtagctttaccacagttttatctaacttctagaagaatttaaattcatataaagataaagagtaacataccaatagagtttagagagttttcagatttgctcagaagaatgctcytttgaaaacctatgaagtagattttacccaatgtatatctggatctaaaaattaaagaaaatatcagtcgtgttcagattcctttataccctgcagaagagagaaagaataagcaacatcaatggagcatataacatgtatggtttagcactttcatatttttaatcttaactattcagccaaatacgtcttatttttttatttttatagatgaagatattgaggtttgcattttttttttataaattgctcagtcatacagttggtaaatagctgacaggagagttcactccaggtcttactggctctcaaacctttgctttttaaaaatctccaaactagcgcctctcccttttaactgcaaaataagcacaaagttatcccagttctacacagtgctaaacaaattcctgtgagcaaacaattagcacaggcagatggagtgagggggaggtggtttataacaatggaaagctgtctgcctgctgtggattaaagattcaaactctttgatcctcctcccagggataggtgagggcctatgtctcctcctcattaacatgagtgatccttggctaggttctcctttgactgacagaatatgggagaaagtaaggctgaaccatatactgggctcaggcttccaaccctgacatgttccacttcctgtctccaggaacattcaccctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacctcctgccatgccctttccaaatcctggaccaacagaatcatcatatacactagtaagcttttactttaagccactaatttggggtgtagctcttttgcagcaaaagatcatcagaacactgccatgcaggagctgataaacttgctcactgttatgtatgtatccaatgactactcacacacacattacttgcttcactctactttctggctttccattcagcaaattttaagaaatgaaaatgttattcgtgggaaattaactcaagatcaatattgttgtagttaatctctttgtaaatggtaaaatattaaattattgtgagtcatttttatttaaagaagtttggttctttaaatgaaagaagtttgggtcttttgtggatactctgcatatagacattctagacatgaaagaatgttgaagacaaagaatgttgaagaaatatagacatgaaagactgttgaagtttggttttttgtggatactctgcatatagacattctagactggagtgatacatcttgttcaggtttctatgtttttaaaatgataacttgacacgcctaccaatgccaatttttaggatatatatctgtatatctgtgtgaactaaggaaaattcaggaatgattaaacctacatattttgccaggagagactggataatgtaagtctttatatttttcacaacttcaagtttatagcatccaaatgagcaattgctgacatacctaggggatttctctgcaggttcaagtctgatctggcctgagggcaacactcttactgagtgtgttcctaggcactccttggcagttggctccaggccacaataaagagccctgatgattctctgagcaggcccaacttccattcacattcatgggaatatgaggatgacttgtgatcttcaggacttagatagactctttcagttggtgtagggtaagctcagctcatctctagagacttcccacagtggagctcatgcatgactctgtgcaggtggcacaggacagccagagacaggcacctaaggagtgcactaccagcaggtggactctccactgagggaggtagacaagggagaaagccaggtgtccacatggagcaggccttactcagggagactgagattttgctctacacatcataaaacgtggaggtcattaatggaatttttcacaggacatgactgccatagccatgatagggtccctggctaatctttcaattrtgatagcatcataagataattttgaatatgaggagagaagaataactctagaactgcaatatccaatatggtaacccctagcaacctaaggctacttaaactaattaaaattaaaactttagttcctcagtgccactagccatatttcaagtactcaataaccacacacacttggctaccatgttggacagcactgacatagaccatttccattactgcagaaagtcctcctatttgacagtccacctctggaaccaatccggagtctttagggacctaaaagactgaggtgctaaatctcagagcagtactctgcttaatgcttagttaaaagacttgctaatctatatagttgatctagagaactttaaaggcagctagttcgtagcaactatgttgctggaccttgaaactgtatgtcaggaacttggtgttctagtggtgacttctcttttatctaccatgttcacacttttcctaccactcatttatccattcagaaagtatttcagaagtccctatgatttaccaggtgctatttcagacactgaggcactgtggggaacaaaacaaacaaagtctcctttctcagggatctcacattccatgtggtgatgcagactgtaaaaattcacacacagaagatactttcatacagtaggaagttttatgaagaatatttcaaaaggggtgtggggtgggagaggttgatgttcaggtgtttgcttgagaatgaactgttcatacaaagaatcaataattcatttgttccacaaatatttattgagtacctgttattagcaggctactttattaggttgccagagcagggttttcttagcacaattaaaacacaataacatttgttagaaattcaaagacccatgtccactcttgcataatgaatcagagtctcgaggttatggtccagagactggtgtatttaaaaatcactgaagtaattttaaggtatagccagaatagagaggacaccggcattcttcctgaaactcaacacactagacaatgagaaatcattaaaatgaagtaaatattttgattgagattgttttggcttcaaaattaataatagcttggagaggaaagaaggtaaattataaaagacaattaagaatctcttaaatgtatttagataatagttacagagggacaaaaatgagtaggatctgtgataacagaaagaataaaaataaacaaaaggacttaaaaaagtaagaataagaaagaagtcaacagtaacccagaaattttcaacctcatgtctaagagaatgatgatgctatttagcaatatatccaaaccaaaaatactacgagaagtaggttgtgttcacttgtgatgttgtaaatttataattactttttctttattttggatgcatgcttttcctttttctgaagttctgagacatacaaaaacaataaagaaaaacatgattttatgccagaaaataagataggaacaattcctcatgctcaatataattttagcctcccacataatccaaaatatatgtgcagcaaattgtgggagtttcgaaattagatccaacttcttattacagttaaagataaaaagaaaacaaggctttgtcttttttaggatcttttttggaacttgcagtataaaaatactctttcaaaaaacataactcaacatcaaagtccaataaaacagtaaactggactaaatatattcgtatattagcttgacctaagtctgggaattgagccagacttttcaaattatactatcattatttacagaaaaaggaaatgttaactaacattattaaataaaagcacatatacacatgcrtaacaggaaacaaaatgaatgttaatgttaacaaatgttgaagatgtgtgtgtgtgtgtgtgtgtatgtgtgtgtatacaaagcagataagatattctcttgagcatgattggattggaaatagtagctatgccaggggaaattttatgcaatccccttggctgtgggctacacatttattgtgttatacaaatatgccaaaaaaaatgccatttacacagttgcctaaaacaaaattgaaattatacattagtgtttaaagtttttttttttctttcgcctccttttcttaatgaatggcagataatgaaatttaggagtttgcaaaaacaaacgtagtttaaattgtaccttagttgtctatgaaatacaaatacattttatatatttatggaaacatttgtgtgtgttcagaaagtccatattttgcattcaagattgaccctgttttaagtcatatttcatttgctacactcaaattgactaaaggcagatactttggcattcactttttgattcattattaaggcattattttgattgattctgcttaaggtagttttcctgatcagagtagacgtttaggccacctatctagacaaatatcccactttcctatctgaaatatttgatctctccttacccattctagggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggtatttattcttgaaagacagtgtaaagtgtctgaaattgcagaagcaaagtggttgctgtagaaatacataccatgacgtgcttcaactcgtttccttaaaggttaaagaaagaaaaatgtgcatcttgaagaaaattccaaaccctcattgtgaggagtaatccaatatttcaatttagaaattcagagggttttaaataagaagcaattattctaggcaaaaagcaaatataaatgccagcagtcaaaaaaccagtgaaaagatatgattaaaactgagatgtaaaaaatagatatttatctgaagttcttgacttttaaagtccacaggcattttcccttaagaaaagaataaaaacattaaatgttaaagaaaaacataagaaatattataaaaaagataattattcagaaaatattagtattttgttaccaacaccaaagacaaacagagtatttttcaatgactggaagccagtttaagtgaggaaaaaaaaaaacacgttattattactgctattatccattatttttatttttacttttggcagtgttatttgctaatcagctaacgcatggtagtggacttgatcttttatgtattataaaggttgtatcttctcattttaagggaatattttaactacattgtccaattgtacactataaatgcagcaagaccaggtcaagtgaaacttcagtgggcgagtctctttcttttcttgtgtgtagggctctccctcccacctgctaccttgactttttagattccctgttcccctggtctgtgcttgtataatatacaagctgtccttgacatagcacgttcctcttttttccttcattatttttaaatggttataatatactcttaaaaacaaatttgaatattactaatagattctaatattatcttactctctgaaattaagtagtgatgtatattgtgttaaacgcttgtctatgctgatgcaacatatgggcaggtctctctctgggcctatatgtatttgtttcatatcgttgtacacagattcattcatttctttaaatgggtatataatatttcagtgtataaattaatcactcgtaagtggctmgtaatttaatttgttgctacttcctcccaagatgaacagtgctttagtgagcatctagccatttctgtatctgtctacttattgatttatgcatatattcaccaccttcttcttccacaaatagactacacatcctcttcatgagagtctacacaaaaatgttacaaataacatttttaacgcaatagttcccttaagctcacacttgtaatgtttctgcccagacttaagccagccaaatgtgtggaaataaattccatttgtgtattaaatatcaaagatagggaacattcataacaaatrtaaasatagccaaggattcattgaaacatttccacataccatctctccaaatctggttttaaagagattgtaacataatttcaggaataaagaccttctggaattgagatttatggaaaagagattatagctccacaagattctagggatgcaaaaggtctggaggagcctccaggcacaggcactttgtttccatgctgaagattcaatgtgggttctgaaaatgctgctttagcaagcacacatttgttccactggtgttggattttctattgattaatagttaccatttttttcttctcttaggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaacttaaaatgtgtttgtaacaagagtcagcacttataatgaaaaatataattaattaagaggttayaaaacttataagcagagtttactctgcttacagaagggcaaacatttgttatttgatacaacatattaagtatttatcccatgcaatcactgtcctaggctttgagtttatagtgatgatcaaaacgatttacaggtttcaagaaccctgctcacatacagcttacaatcctatgtgggaaaatgataatagtgaaataattacattaattaatatatacttgattcaaatgtaaataattattctgaaggaaagacacctacatcaagagagctggcttaaattcggggatcaaggaagcctttccaaataattgttgatgggattgaaagacaattgtgggatgagatgaccacctgggcttggtatgggggagatacaactgtcagtgggaaagccctggagatggggaagaagaacttcttcaatggagagaagttcctgagtgagkagaaggcaggtgaccacagtgtgaagtgatgctatagaagccaaccacgtggctatgcaagcagaaggaatttatccaaaaagaaagggggaggcattagagggatttagtgtggagagtggtggtgacaagatcagatttgcaacttgcaactctctctcaggttgcagcatgggggatgatgggatgagcccagagtggactgacgcatttccagtagtccaggagagtggcatgtggcatgaactgtgtgaggaagggggagctggggggaagaagtggggtaacaacaccctatttgttgttttgcttcttacactttgaaaaatatttcaaagcaggaatgctattccagacatttaacacctggaacaggaataagtaccaaccaaatatcgtgggagactgacgaatcagaatgaacatcagctctgcatggcagtatggttttaaaacactttcatgtctatgtaaacaaagtaaaaatgttaaaagattattttacgcctttggttatcagatagtcagacttttagtagtttatattttattgcagtctgatgaggtctgcttttaatagtagttttctcttcttcccccaaccccattacattaaaatggcaaatgatacttttccttgttagtaagcaaggccaagttaggattatcagaaagtcaatacctaaacacaaagaatagtgcagccaaacccggaaaatattgtctgttttgccaagaggaagcatctcactgagtatctggaaagctcattgtttctcaattatggttattttattagttgccataactcagctatagtcataatgtaactgaccagcaccgatgatgaaatcaataaccactacaacagagtaaatgctgtttggggtgcaagaaacatcatttttatctaagtgaaagtacatctcatttaaatgtatttcaagttgacattttgtatatattgttaataaacttcaattttactaaaatctctgcaatatctaatcaatatactgaatgatatgctctccccttttgtgctcaaataggatctgtttatattttagttaagaaatgctatgccattttattatattagaaaaatatttactggtaggaatttggtttaaactctccctgttattcagctgggaagtatattacaagtaagtctttaaagactacaattggagaccgggcacggtggctcatgcctgtaatcccagcactttgggaggccaaagtgggtggatcaggagttcgataccagcctggccaacatggtgaaaaccccgtctctactgaaaatacaaaaattagccaggtgaggttgcaggcgcctgtaatcccagctactcaggaggctgaggcaggagaatcccttgaacctgggaggcagagtttgcagtgagctgagattgcaccattgcactccagcctggagaacaagagcgagatttcgtctcaanaataaaaaaaaaaaaaaangaaaaaaaaagactaaaattggagagtttaacgtatcaaatttaggagataaatggtaaataatatgtttgtatatgaaaatattttaatacaatatttgaaatgaagaaactgagatcacacaactttttgagcgttgagtttatacatttattttctttctttctttctctttctttctttctttttttttttttttgagatggagtctcactctgtcacccaggctggagtgcagtggcacagtctcagctcactgcaacctctgtctcctaggttcaagtgattctcctgcctcagcctcccgagtagctgggactacaggtgtgtgccaccacgcctggctagcntttttgtatttttttagtagagatagggtttcnactgtgttagccaggatggtcttgatctcctgacctcgtgatctgcccatctcggcctcccaaagtgctgggacgtgagccactgcgcccagcctattttctttcttttacctatatcatttcatttttttattgatacggaatattttacatatttatggagtacatgtgatattttgttacatgcatagaaggtgtaattatcatcacggttttggggatatatatccccttcagtatttagcatttttatgttttaagaacatttcacattctctcttctcgctactttgaaatatacaatacattgttgttaactatagtcactctattctgccattgaacattagaacttaaaatactttccagccaggtgtggtggctcacacctgtaatcccagcactttgggaggccgaggtgggcgggtcacctgaggtcaggcgttcaaaaccagcctggccaacatggtgaaatgtttgtatttgtaaaactacaaaaatcagctgggcgtggtggtgggcacctgtaatcctaactactcaggaggctgaggcaggagaattgcttgaacctgggaggtggatgttgtagtgagcccagattgggtcattgcactccagcctgggtgacaagagcaaaagtctgtctcanagaaaaaaaaaaaaaaaaagaacttatagcttccaactaactctatgtttgcacccattgatcatcttttcttcattccccactctcagccatacacacttcccagcctctggcatctatcattctactgtctacctacatgagatcaacatttttaattcccatgtatgagtgataacatgtggtgtttgtctttctgtgtctggcttatttcacttaacatagtgacctccagttccatttatgttgctgcaaatgacataatttcaatgntttttgtgcacaattagtattccattttgcttatctatttgttaattgatggagatataggttgatgctatatctttgcaatggtgaatagtgctacagtaaatatgccagtgctggtctccctttggaacaccgatttattttcctttggataaatacctggtagtcgaatttctggatcatatggtacttctatttttaattttgctcagaaatctccatagtatttgttcataatggctgtactaatttacatttccaccaacagtgtataaaagctcctttttccctgtaccctcaccagtatctgtcatttttttgttttttttagtaatagccattctactggggtaaggtgatatcacatagtggttttgattcacaattccctgatagttagtgatgttgagcatcttttttatatacttggtggttatgccatttgtatgcctttttttgagaaatgtctactcatgtcctctcatgtcctttgcctactttttaataggattatttgtgagatttgtgaggttgttttttgtttgtttgtttgtttgtttgttttcttacagttgagctatttgagtcccttgtattttctggatattagtcacctgtcagatgaatagcttgcaaatattttctcccattcaacaggttgtttggagattctctttaaaatagctgcaacaaacaaacaaacaaacaaacccggccaagcacggtggctcatgcctgtaatcccagtacttagggaggctgaggcgggcggatcacgacgtcgggagatagagaccatcctagctaacacagtgaaaccccgtatctactaaaaatgcaaaaatattagcctggcgtggtggcgggtgcctgtagtcccagctactcgggaagctgaggcaggagaatggcgtgaacccgggaggcggagcttgcagtgagccgagattgtgccactgcactgcagcctgggtgacagagcgagactccatccaaaaaaaaaaaaaaaaaaaaaccctaggaataaatgtaactaaggaggtaaaatatacctacaagttgcactaaaacacactgacaaaagaaattgaagagggtgcaaacaaatggaaagatatcctatgctcatggatgaagagacttaatatgattaaaatgatcgtatcatccgaagcaatccacacattcaatgtaatccctatcgaaataacattattttttcacagaaaaaaatttaaaaatcctgaagtttgtatagaaccaaaaaagagcgcaaatagccaaaactatactgagcaaaaaggacaaagctttaggcatcacactacctaacttcaaaatacaaggctatagtaacaaaaatagcatggtgttggtataaaaagacacatagagaccaatggaacaaaacagagaatctagaaataaaaccccatatttacagctagctgatttttgacaaaaatgccaagaacatacattggggaaaggatatcctctttaaaaaatgtttgcaggaaaattggatttccatatgcagaaaaatgaaactggacccctacctctcaccatacacacaattcaactcaacatggactaaagacttaaacgtaagacctgaagctataaaaccactagaaaaaaacagggaagacacttcaggactttgttctaggcaaacattttatgggggagacctcaaaagcacagaggacaaaaacaaaaataaataaatggggctgtattaaactacaaagctgcagagcaaaggaaagtattttcttaatccttactggttcttaaaaagttttggatgttgaccaacacatctattatgataattaaatgatttggacatgtcaagcttgtcaggatatgcgcaggttgccccctttaggaagagcacagtgactctttctaattctatttttctatttcttaaacatagctgactataaaattgcaaagaaatttgtgtatgagctagggaagatgttgggttgggttgagattcaaggaaggagttggactttaaaatggtggaatcaccagtagaggacaacaccgtgtaccaaaaacgttcacaggacaagccaggttgtacaccatgatatatgagttgtgatgctgatgaaggacatagtaagcttccaataatgggtcaaaaaaaaaaaaaagaaaaaaagaaaagcattaatattaggcaatgtattttggtgcctataatttatattcttatcaatacggatagctccatattgatctgtttatatatatctatttgtttatatcatttgattaaaatatggcattgaccattggaaaggtacatctcaaattatcctggttaaatgtgaaagtatgaagaggctgtgattataagcatttaagtttcaatcaagtagcaagtgctgtcaagatggtatatccaatcagatattgtgagggacatgtgattgctatagattattctgctgtcttaagagataggctgtggatattcagattgtgattttggagtttaagagggcaaagtaaattgcctgctgaactcacagtcatgtttgagagagactgacaggaaaaggtaaaaatgaatcatcatctacaactggctggattggacctgacggaataagatccagcaggaaaggtgtgtgactaccattcctggaactgggttttgctgaatcattggacagttttgctgaatcattgagcatacaagttttgagggatacatgtgcatttagaaagtaacgaataagaatattcataattatctgctacttttcatagcccatgtattaacaccaaagcaattttagatgagctatcaataaaaatattaaaaaagaaatcacagtctatttatttaacacacattggttatagtcaacaaggtaatgtgttgtgctgcaataatacaagtaaacatccgtctaagaatccattgtttagtaggtattactgtacgaatttttaacaaagctgctttaaacactataccaacagttttaaatacaaaagcccagtggtcaagctctaatataaatgaataaatgtggccttctggaagaccctagagagacaacaggacacagagtggagcacaggaaagaaagaagtccacttcctgcataaatggcggcggcaactctgtttcacctgacagacgcctcctcgaaatgcagtcccatttaaaacattttttgattgttttagataaaacttataacattgttgaagaagcaactaattctagatatttttataattttaagctgccagaaaaagtaagtccacaattggaaatggcccaaggcccccaggatgtaccttacctatgccaatattgagaagattattccagtgcaaaaggtccatgtaactttcattaacactatggtttgttggaaacacactaaaccactgttccataattcctttttttttccagttactcaaagcaaaaataccagaattttatgtttacaaatgtgagtttttaatagaaacatgcacagtgtatactttatatattgccggaattgacttatcgaatgataatttaacaagattgttcatttgaagtttatgcccacttttataaataaaagaatcattttggttgtcttcctctctttctctttatttttcctttcttatttcagtctacaactactcccccttcttctggcccatgtggagatatcccatttcccaacctgctccctgttcagttacaaggagggagggaagacatctggcagaggaagattcccagggaactatgaaaggagatagtgactactgcagagcttgttacaataacagactattaaggctggtgcagtggctcacgcctataatcccagcacttcaggaggccgaggagtgtggatcacctgaggtcaggagttcgagaccagcctggtcaacatggtgaaaccccgtctctactaaaaatacaaaaattagccgggtgtggtggtgagcatctgtaatcccagctacttggaggactgaggcaggagaatcacttgaattcaggaggcacaggttgcagtgagccaagattgtgccactgcactccagcctgggcgacaagagggaaactccgtctcaaaaaaaaaaaaaaaaaaaaccacaaaaaacaaacaacaacaacaacaaaacagactattagcactttctcatatcccttgtttgcttaagaatagtatttgaataatataacggcctatattttatctacctactctctgacttcctctggtttggaggggggtgaatcatcagaggtgttgttgcacagtatgtgtgtgggtaaatagggtcccttttctctactcatcttttctatgcaaaataaagccattggttataatgaagaggaaatcagaggggaagaggtctattttgaatttttgtaaccgaaaaagctcatgattttatgtgaatattccattggctgcttagcttgcctacttacttgaatttggagtttattcccaacactgcagcttacatgcaccaaggtttgggaacattctgtaaaatttccttgaggacaaatatccgctttgttgtattctttgttatttatccattttgccaaattatctgcaagtagaaatatcgaaataagaagctctttagcaatttactttggatattggttttcttttgaaggacagttattaaaatagcttgtaggattactcattttcrtttttcttctttttaaatataaagcaatgtcatcacttttttccctgtattatatttctcctcaataattgatatgctacattaaaggaacacaaaatggtcttaattatgcaataatgatcaaggcaaagagtgtttcctgggaactaatggttgcctgagaggaggtgatggcttgaggtccagctggttattaagccgcaggaaatgctgcaggccaagatttgtattatttctctgagatgaaaatgaacccaaaaaaaggcaaaatgggtttttctccactaatgggtaaaatgaactcattttggatgcagaagacctttatgtagaaggaatgtattccataaaagcaaaatcaaaatgttcagtggtctctgctttttgtttaaaatatagtatagcacaaataatagtccattattgattttaaatcttgatgcaactaaaaatatcatgcaacacttgagtttttgtctagttctagaacttccatagaatattatgtccaacaattgttttgatagcttttgtaagctaagaatatattttgtatgcatttaacattgaaaatggttacttctgaaaatattcagaaaacagctatctcataacaaaagaatacaggcattattttcttttttttctggagttcattcaaaaaatattggggaaaggtgtctcattaaaagatgcgttgagatttgtggtctctctgcatgattagagatgaatcacttaaccttcttaaagaaactgcctaatcaatttgtaaagtagttagtatagctgcccccatctctgatttgtagtaggattatgcaaagcagagtattttgtagatattaatattactaatataaaaatgtagttattactatatttactttaccatcttaaccaagtgaaacaatatattttatcatattttgccatttttgccacccctgtgacatggggtatgtcacagggcatagtagacaactgaaagagctcctaatagtcaaaactggaaaagtttcagaacaaaattaaccagtagtattagattataacccaaaatacaaaataaatgtttctgaattcattttgatttaaatgaatgacagaatacataagtcaatgggggagagtttattcttgcatgcagaagaatccagataatttatgtggatgccctgccttcaaagaggcagagcctaactctcattcctggacagcacagagtgacttccttccaaagagtacaggaccgaaaggggtgaccaaaagattgaagaaagatcaagcagttatcatgagtaaagcaaaccttgacaagtttatcgcaatgtttagaattttgttatattcaatcgaggactttacaaaattgtgttaaactttatgatggatatgggtgtccttcttaatagagaaagttcaaaagccgggtgctttggaggaaacattatcttttgtctgccactataaatgtgactaaaatagtacgtaataagcatatggccacaaacttaaatgcattatgttgccaagaaaatatgttggcaggtgtgtagcaggccttgcagaagatttgtaggaaaaatcataaaacaaagtacatagtgtgagatgtttgctatacatgaggattttttaaaaagcagatctagtagaatatgatttacttagagaagatttgtatctcttgtgttcagctgaattatagcatctaacacagcctgtgccacacagtaggaactcactcaatttttgttgaaattattcaacgaatattttattttaggcttttgcaagatatgactttggtaataaatgtagcacacttaattcattgaacactaaaggaaacaaatgctaaagaaactagtttccaggcacaaatgacttgcttaatagcacaaggcacatggtggggaggggaggtaactacaagatgccaccctgaaggagtcactgtttcatctggagcactagagatagtgggtgctattgatgttatctagcaagactgaggggccaactttctgagttcaaaccgtggtttttccacctgtaaatgaggaacaacgataggactggcctcagagataacccatgaggactaagttggttaatgtagagtacttagatagctgcctaaaactatgtaatcattatgtaaagataagctattattaattttaatggtcataatttaaatgaacattctaggatatagttgcagacattgcaatacaccaaagtcatttatgttataatttatatgctatccaggagagaaattgcaacacagatgtgcaggcaccccactatcaccccaaattaatattatggttattaattcaagacctataaaatagcatgtgtcatttataaaactctcaaatgtccatatttaaaaacttgcttaaaattcttaaaaatcaaaaagttaatgggttttgaagtctcttgttaaaaaaataacaaatcagtgtaaatgaatgacagtttaatatcaaaaagatgaaaagttgatagccaagtaacaaatgaaattgttaagcagggttgaaaaattaccaagtgcaatggaaaaattaacacagggattttatatttgtaattattgattaacttcttctattaattcttattttgacaatatttaaagccaaatattggcatatattaaactgagaaccgaatccttaaattgctgtatctcagggtactaaaccaaaattttctaaaacgttgaaacaaatttcactcacttgggctttattgaagatattattgctttatcctttagttagaatgatgttattataatgttgtttctgaagaacataccataattaattaatgttaattccccatttcttttatcatttagatttctacttttagtgtatttcatgaaggacatgaaacattactattgaatgacatatacaaaaagttgaagatgtgttaatgttcttttattaggctgatggaagtaatcaaacatatttattatttatcttaggtgaagtttaaataataaagtcttgtatactattaaactatatattacttttacttgtcaccatcttttctctaagcctggtttagaggtaaaaatcttttcaaattgtgtggcttcaacttccaacttgctcaccttctctgggtaagagttgaccatattctatcaaggacacaaatactgtattccttcttcccagggcatttatatagtcacagggaaggccttagcctgccttttggacttccctatgctttaagatttttttctttatgtacgataagtagaagaggaagaaatacatcaaaagaagtttcgctgcaattcaactaccttattgaccttaacttcctcaatcaactaaaagtatctttctacatcattcatttcagcatttttccttttttcttatttatttgtttttcttttttcttttctatcatccatttgacttttgtcacagatagattttaacagcttgcattgtatgttcattttcctaaaatattagagcttctattaaaagattggtgtaaagaaattaggggtccaggcggctcatgcctataatcccagaactttgggaggccgaggtgggcggatcacgaggtcagaagattgagaccatccttgctaacacggtgaaaccgcgtctctactaaatatagaaaaatttagccgggcgtggtggcacgcgcctgtagtcccagctattccggaggctgaggcaggagaatcgcttgaaccaggagttgcagtgagctgagattgggccactgcactccagcctgggcaacagagcaagactccatctcaaaaaagtaaataggataattatattcttatattcattaacatattttgatggatcccctgacatgaataagggcagagacggtagcaagttaagatgggccagttggatttcatgccttcaaggacctttcattcgagcataggaagaaaaataagagtatacatatttataatacaaggccaaatgtttgaaatcgtgaaagcttccttctgtatctcaaagagcaatcaactctggcacaagtgatctacagtgactttgtgggagcagttggcatctgaaaaacatcttaaaaaacagtctataacttgtatttgtttcttttcacttacatgttatgaaagaagagaaatagagcctatgtctgctatctcctggaccctcccctagtacatttttccattgctaactttartctacagcctttcactgtaataaaccattactaagagtgtgttagtgtttctaaattctttgagtccttttagctttcactgaatctaatatttgtgttaggacccccccacacacccctaaaaaagaggctctagagttcgtcagctgggacattcaagtggccaggcccaatatattcagaaatgctgacttccttacaaaaactaaaagctttataattttcaaaaaaaaccccaaacctagtttgaataacacataacaagttttgagtgaacgcttagcactgtctcaccatgagctcatggattggaggacagtggcagggccacacacgtgccctccctgtagccaaatgtaggccagtttacagacatcaggaagttgccactgcgatgcagtcattcttgacctctgtgaagaaattcttccagttaaaaatttatttatgtctacaagcatcctctttcaaatgcaaccaccccgtggaatattttaagtctcacagaaaagtcacctttattttagcatgaaatggcttaaaaatcagattatttttcttcaaacatcagatataatttccattaaggaaatagaagtctttatagtgattgatggagagaagttattttggcataaaaggaaaatgtgcttgggtggaataccagagcagacagctatgagctgtcagagagaagaacttgtggggagcagaggagaggggaccttgaaagctgggagagaaaggcacaaaaacagcaatgcaagaagtatattttaaccactttcagtttcactactagctgcccctacagagtgattgtgattaaagaaactcttactaaccgatttttaacccgcgctgagtcttccatgtatcttagcttgattttttttgccctcaatcacgtgtctacactagatcaagtgcaccatctaccaaatcaaacactcgtttttaagtagggtgtaaactgtcactaaggaatgtttgggtcaatgtccacctatagatactgctctcactgtacttgaggcagtattggagaacttatgttttctatggaagacttagagcattactggaaaagagacggctttgtttcctttcatattaaatgtcaaggagaggcggtaaagcctctcctctgtttttctatagaacccagttcagggctgtgtctcatcacttactatcctgtgtattattaatgatcaattcatctactcctcaccagactgcaaagtttttgaggaaagaactccttcattctccactatctacacagactacgtataaattaacaatgaataaatgaacaaatgccttcttcatatatcttgactagtctatatgttgttagcattatatttaaataccactttttcataagagttgtggattagaaaactgtgaagggattgtttgtttgtttgtttgtttgtttgttttccttaaaaaattaatacttgcggccgggcgcggcgggtcacgcctgtaatcccagcactttgggaggctgaggcgggcggatcacgaggtcaggagatcgagaccatcctggctaacatggtgaaaccccgtctctactaaaaatacaaaaaaacattagccgggcgtggtggtgggcacctatagtcccagctactcgggaggctgagacaggagaatgacgtgaacccgggaggtggaggttgcagtgagccgagatcacgccactgcactccaccctgggtgacagaccgagactccgtctcacaacaacaacaaaaaataataataatacttggacaggaagaccacagctatcacttctagatctaaacattcttcaagatgagtggagacagaggtagagtgtgtgctggatggatataggagtggacttacttggttgtcatcatacggttgtaccatttctttttaataatgactgaagatgacattgggaataaataaacatagacctttgagtttcatagccacttaactccctagttttgtttttcaaattagttgagaggtgatacttatagccataactttaataacattaccatcatcatctcaattgtggcagctacaatgtcaagaaactcacaaagttaaaatgtgaagaaactttagaggtggtttggtgtggagaagattgatgttgatacgattcatgtatctttcaggattccatgggattgcactctgtcatcaatttgctctaaggactaagtctgaaaaaacttattgtgtgtcattactgaaatactcagcagtggtttggtttctgaatacttttaaagcattctctctcttctccgcattataccataaaatatatcttagcatattattgttttcacttgccatttgtttaatatatgagaatatattaaagcatatgccttgaatcaaatgctaaccagattaaactatatctaagagagtgtgtcttttcaaaacagattgtgaagttgtgttctggttcccatattactgccattgttcaatattttgggacttctattttggaaatgcattcagttccaacttgtagcccctaagaaatgctccctacatctaaaggctaagatgccctcctttattatttttctgatcaaatatttaagaaataagcttcaaatatttgttaaatttttctcaaaagtaaaatttttatgtttaaaatatgacaatctaattgtcatctttaatgtattaaaatcttttatatccagtttttattttattttatttacttatttatttatttgagatagggtctcactctgtcacccaggctggaatgcagtggcacaatcttggttcactgcaacctctgcctcctaggcccaagtgatccttccaccttagcctcccgagtaactgggactacaggcccacatcactgcgcctggctaatttttatatttttagtagagacggggtttagccatgttggccaggctcgtcttgaactcctgacctcagttgatccaccctcctcagcctcccaaagtgctgggattacaggtgtgagccatatattcagtttttagaagatcattagaattcaaatgttgccagactttaagtgtgggtcactatctgatggagggcttctcttagaagatgtccccaatggcagggccttgttataaaggttggaagagagataatcctctgactaagaggccagagaagcagaagattttttttcatcagatttcacgtcagtaggaagacagaaaggagaaggaagagaaggcatgaacagcatatgtgtgaagtagaatcttaatagtgtgcatcttttaagtcaggattccgtctactgttggccaaaataaatcattattatctggtggttggaaaaaataaggacattccttggttttctccaaaaacttattttggtgtttcttaattacccttaggagaccttaatgatcaacactgtatcaacagagaaagtggaattttattctcttatagaacagtgatgttattatgcaatgtattcacataattatttacagttcttcagttctagatgactgatactacagaaacctgagataatccctgcttccattagtttgggtggaacttttgttgagagacttgagtcatactgaataccttgaattactgccaagagctggtgatcatcaagcttgagttaatatcaatgttatgttgctatggagaggataactgcaggagaacaatcatcatgtggtaggttttaccacgtggcctgctgaactccatgctcaaactccaactacttttaagtaatgacattaaaaatcatattttccatttatctgtggaagctagtgagtaaagaataagatagagtctactgaacctatagaatgttactaagtattaggtgttgtatttaatttccagtttgtctaatgctggaggcaattttaccttctcctaccagtgaaaaagtttatgccagtaagacttgtgatttttgttctcccccaacacatgcttctatataaatttattatgggaaaagtgatattaataaaaactttctggaacaattatagatagagtgtggtctggtgtgacagatattttgtttcttcacaacattcattctctgagtattcaccatggatcagatattctgtagtttctgtagtagatacaaaagctttacaaggtgtatttttccacaaagaggttagctagattaatagtgagaggatacatcaaagaacatggaaatgatttttagagaaatgagagcaaatactaaagtattgaattaagtaaaacaagaaaaatagctcctcccaccttcaaaaacattggtgagaccaggattgtggagggcaccttggcaatgggccttgtagctcagtgaatggataaaatgtgtacacagtgagaagagaagaaagtgtctacacagaagttagtttttgtttaatttgatattttctctttacctcgttctagtcaagatgacctgaagccttctagtgaagaaccagccaggcaagttccacttcttagggccgttaaatcccttctcttattaatgatgttaattgcatttggatctccatccagatatttgccctaccttaatttcatgttaatgtgccatgggctaaagaggcagtattttttaaacgcatctgtaagtttcatttatgacagaatttctgtaataaaagtgtagtcaagagtgttgatggaaaattagggtgacataaatacgtgagaactggaaaatgtataatcttaaacagtacacattatttttattatctctctttcccacaggctgatgaggcctgggatactaatatnaaaaaccaaaattagaaacttctcctctgtggtgtttattgcttcgcctgcagtgcatgacatcttaattctaaagctctnaactcacaaaatctgacatcgttttaccctctgacacgtcaaaatcagggcctaattgntcctgtggttgtgaattatgaacaaatatactttctaagaagatggatttttcatttaattttccttttcagcttcacaatatgtacatatacagaggttgcctgcgattttaatatgctcacacctacaaaaacacacaatacacacaaactttcaaacgtaagcacacagatctgtaaacatacacatgaagatttgttgcaacacaattcattctcaaatctatttcctgttatgcttatgattaagatctataacttctcagggttgatttatttgttttgtacgagactgagtaaagctaaagaccacgaatatgatgggtgttgctaaaataaacttctcaagagacatcaagttttaatctgccatatttcaaatattccctgttgaaatataaacataaaggaaccattaattatataaaaatagaaatacatttgtgactttcagagctgtcaccgaatagatattggaaggcaggttatttagaggactcatgtaagacagaaaagaactacgcacagatcaccgatgatgacacagttatgtggagaaagtaatctgccacaggtcacccagacagggagtgggaaagtgatggctccgtcctcgatcacttttatatccctttcattccaaagccaagcatgttctataaaagcagaaatctctgtactcttttgacatcctaactccttctgctaccctcatttaccctcatacatgttttatacagatgtgggcttgtcagaaaaatcacaaaattttaatgttagaatggaccttatcatgctattttagttatcagctgctgagctgttttctatgtttgagttcccttctctctaaaaaatatacaaaaatcaatagaactttcagtgcacttgcaggtgggttttaccttttttaggccttgatctcacagcctgatccttaactcatctactttccaatactggctgacagagcatccaccatccaaaggcagcgtagacaaaggttcaatgagtaggaactcttaattatgacataatgacattaataacttttaccttatgttttatgtttttggagacaaaataattccaaacttattattataaccataaacataaatatttgtatcattaataacagtgtaggaccttaatttatagtttaaccattcacatttgagtctttaatccctgctcaattccaaatgtatacatagttttaggggtccatttttatttctctccacatgtagtgatttatgtttctctgtaccttctactaagtaacctggccttattccattatatatttagtttccatatatacatacatctgtctctgaggacttttaatttcatttcattggtcaatgtatctgttcttgctgttgtaacagactactgctactaatactactgctgaattactattattattattattacttttcagtatttctaaagagctttttaaaaatatgtcattaagttactgttttaagtaaaacattttatatagagattcatatacatattgaacttatgtttttattttcttgcatgtatcttaagtgatcttgaaatcaacattataacaacctgataaaatagagtgaaggtttctgatctttgctcatttgcaggagcaccttatataagatgtaaattaggtaaacgtttaacatttgggagaaattcactatacaacaatctgattctgagactccaaagatcgttttttatgtttaaaatatctatttctctattcaaactttcattttatttgccgcatctaatatctgacacatttccaaataagtaaaaacaaaattcaccaaatcttgtatcttttaaaatgtatctttgtttcctgtcttctatgttttgattatttcttttaaatttttaaaataaatttgtgtttagttttgaaccataaaaataactcattcaaagtcatcaaagtaaaagtaatcatctcttaggcatatagttgtcagtaatctgattttaacccaacagactatatacatatttaagacagggtctctctctgttgcccaggctggagtgcaatggcacaatcatggctcactacagccttaacttcccaggctcaagcgatcgtcccaagtagctggggactacaggtgcatgcttccactcctggcaaatttttgtattttttgtagatgtggggttttgccataagacgaattgttgagtcaagatgtagatggcacattagttcacgttatttcagttaaggtttcctgagcctctactttgtgccatgatataagcaaggtgctaagtctgtgctgcaaacagcagtcatcctatccaaaccgtacacttacaagtgaggcaacaaaggtatataggggttcgggaaaaactacggaaagcgtgtgtgtgtgtgtgtgtgtgtgtgtgtgtatcaggcagaaaattatcctcacattttcctacgagtatcctagttgatcctctgccaccatgctctttccatgggtgccctttgctgtgtcctttccaccccacccttccagagggatctggatgtggatgcctatgctgagtgtaatgaagcctgagatgttgttagaatttaatgaataaggccaagtatgctaacattttttcaatccacaaaacgaaaattagatcttgacctacacaaaatgtggctagctcctctgttgagaaaccctgacaccagatctattaatacctttcctatggtcactttatgttttgaaagtttgctactatttggtgatgacaccaccaactaggatgaatataaatgttcattttcaaagatgttaaaggcatcattctcttatttctaataattaaataataaatgtggagatacacacacacacacacacggtttccatagtttttttttcaggcaaattcgctaaaatctcataaacattataattattattaactcctaggaataatatctacatttaaggaaagagtaattttaatttaagtagacacatttaatgatgcaagtatggatacctcatgcaaacaaatgcctttatacttactcagaataaataatgggaattccacatggaagcttatgagaaggtctttaatgatcttattttgctttggttttagctttctgagtaaacaagcccctacacactgagtattagattcacctggaggtcttatttcataatgtatccagggctttagccctagacatgctgattaagactggggtgggctcaagaatttgcatttttcacaaattccaaggtgatattgattttattcttagtagatcttctcattaaaaataagtgtaaccctctgcaattaacagaataaagtcaaaatctctatcgcaggattcaacagagggatgacaatctggcccaaccaccttgcatagctttgggacctaacattactcttgttttacagcagtagttctgccattcgtaagtgaaatgtggtctgttctctgaatataccattctctttggtatctttgcactttgatcttgctgtattttctggccagaaagcccttccacctttacagtttagaaactggccacttacccttcaaggccaagttccaataaagtttcttctaagaagagtgctgcctatttccaaatttaagtatataaaattgaggattgaggaaatcccaaaattccagtacatttgtttcataatgcaatctaagatcattctgttaatgttccacgtgcttccaacggctccacgaagtggtatgagactcaagttgaattttgaatcacaaagtgtattcattgtccacctgacatctttttttattttataccatgatttttatgtaatacatcatttgtgtctctaagagtttttcacgtggattttaataatgtgccaattcacaaaagaatttgacttaacacttctgagcattattcattgatacacagttgaaatacagatagtttagataggaggaaaagtcagtataaaggaatgaaattttttttaaagctcaacatttcctagagattttacttctcatatctaatggtgtaattctctcttattaaaaaatgtgttaatttaaactattataattttatcagatgctgatttcgtgtgtgtgttctgtgtgtgtttgtgtgtgtgtgagagagagagatgatctgatgtgtattcctaagtttacaagattctaaaccttttcacttataaatagatagttcagagggtgacatttttggtagagaaatcttaatgaagcttaaaatgcaagtttctgtgtagaggtaccatctggttaatctgcttcaaatgatggtggatgcaccatcattacccaaatgggtgaaagcctggctgcctatagtctcccttaaaggttaaggagtgatatatgggtgctaaagaaaggcttatcaggctactgtacatcagagcactgacaaaacttcctcaggaaatcaccaaatgaaacaaggacctattcagaaatgttggtttatagatatgccattacaatggaactcatctaaatgacagcatggcttaagtgaggaatttttactcccaggtcaggaaattctaaggcaggaactaatgcctatcttaactcttgagatgtggccagaattcaggttgtttttctactgtgtgctggttttctcagacatgtgaatttggggagataagaacagaatagcatattagctgcaacatgtggcacttgtcagattaacaaaaggagtgggaggcttcatacaagtctccattttccctgatagagtttcaagttgagaacagtataatgttcatattttacatcctgatgggaaaatgggtaagaataaaaggtgtgtgagccatagaaacagaatctgtttcttttcactttttatagcaataggagctaaaggcactctaaaagctcacttgaaggccacaaggccttgcttttgtcttttgttttcattttaactttctgcttttttacaaaaaaatctatattttgtcccattatttaatggcaagttgcctttaaaatgtatctggcctcatcacagaaatactaaggtatgtgattttgcataaataatcacagagaatggcatttcttaagttaattgtgtctttctcactaattcccatcaagagcgtgaaagctacaatttaggtgatctttcagacgattagtgtagtcatccaggaagtctcttttgttatctaatctaagtcactctagctataattcccccttgttttttttttttttttttttttttttttttgagatggagtcttactctgttgcctaggctggagtgcagtggtgtaatcttggctcactgcaacctccacctcccgggttcaaacaattctcttgcctcagcctcttgagtagctggattacatacacgtgccaccatactcggctactttttttgtatttttagtagagacggggtttcaccatgttggtcaggctggtctcaaactcctgacctcataatccaccacccccctcagccccccaaagtgctgcgattacaggcatgagccgctgtgcccagcccttgttttgttaggtgagaaaatgagcctgtttccacatggagggcagtggtggtgaagttgtattatgttttgaaaaatactgaaagcaaacagggagggaagcagattaacatgtttttaatcatttatgcactaatattgtatacaatgtgtgtgtgtgcctgtgtaaagaaagaatacactgcatgtaacacagtaaggtattgtatttatatattgctcaggcagaagatatttaaacagcctggattaattcactcatcttgtttgtactaagaaacaaagactgaatgagttacaaataaacaagttccccaaattgtattattgtggtctcatttgagtgtctcataattgtatatgtattgcatttatcacaaaagttatatttgaacacaaggtggacagttataacgtgcatgagcaaaactatagtgagccatatctagcgatttagctttccaggtgaaacagccactctagttatgtaaagtgataggaaataaatcaatcccatcttagcctaggacgacattgacatcagcatcagttattccaataactgcataatcaatatttatgggcttaatcaagagagacatgacacctggattcgctgcatgtgagaagggagggcaatgtcaaggtggatttggtgaagtccaggtggggaaagcagagtaaatcagcagcaaagtcaacaagcaatctgctcacagatccacaatattcggctgctttatagaacacagctttattctttgtctgtgatggaatatcaatgcttccattttgggaaaagtctaacgaattctttagctttttaaaattaaaaaaatatatatatagccagtttgtattttgtattttttataaaaggcatataaaaatgcaaagcatagtttctgtctttgagaagttttgaatcttgttggtgagtcaagaaatgtagaagaagcaattataagcaggatttgaatcctacctgtatcactaatttgttgtgttgtacaaatcaattcttgtgcctaggccaaaataaagcaaaaaaagactacactggctccacattccaagtaaatttactaattcaatggtactataaaatgtcaatgaatatattccagaaaataagagtgaaaaatttcaagaatgaaggaaaagaagagtcagatgtggtgaaagaaggcttggattagcaagcatttgattgatattaaaagcaaggataagaatttgctgaatggagaggtggggaggagtgagggttattatagaaaaaaaatgaagagaataggaaaacaaacacaggtgaaaaatgagcatgaggggatcacctgggattgagaagatgacatcaactgctggaaatggaagttttgcatggagagcatcaggtcagtttacagaacgccatggacactgaaataacagggctgggtttgaagctgttgaaaatttcaatcaggaatcctttcctatctgactcagagaaaaggggtgtttggaaaatgttcatctgaagcaggggggcggggcggggagcaagattaaactggtagctatcatttccagatatgacccagtccgtagaatgtttgattattaaacaaaaccaaatgctaacatcagcaggtccacaacaaacagaagatttacaatctcctgaaattgcaaagatctggtagaatagatttcacatggcaatagttggcagaagctaagttgcttctgctttccatggctctccttatctccacattgttgtgactgaagctggcctgctccccattgtcagcctggaacagaaaggtgtttgcatcagagatcactactgtagggaccatagatggacaagtgctttaggaaactactaccgaggtctcatcctgagatgagaaggctctcatttagaacaaacatggaaaggaaggattgtatgtgagttttgttttgaaagcagaatcaatatactaataattgagactgagtgaactagtctaggaggcaaaggagaggaactagcttacacacgaggaagcttaaaaatattgtttgtgtatattaaaaataaaataaatgcctaggcatggtggctcacacctgtaatttcagcattgtgggaggccaaggcgggagaatcgcttgaggccaggagtttgagaccaacgtgggtaacatggagagactccatctctacaaaaaatttaaaagttagcccaatgtggtggtacttacctataattctagcctactagagagtctaagatgggaatcacttttttcctggagtctaagactccagtgagctgtgactctgccactgtactccagcctggatgacaaagtgaaaccctgtcttactccaaggaagaaaatgaaaataatacttttgaaagtcctcagatagaagactcttacctgcttcattttattagtataatatatgacaaattaaaaatattaaatttaagtgtttatttgccacttactcaaaattttaggtatacacaggttgacccagaaaagaaacaaatgctaaatccaaaaatattgtcgtgcttcatgcctacattacttttgagtacacatatttcttctgtaacccattataaggagttttcaaaatataatatgttcttaataacttacattaaataattcagtggtaaatacaagttataatatattgaatgttgactggtcaagagttcccttttttcataaaacagatttcaattctcatgttagtttggccaactgaaagtaaatatgcttggtagaaaacagtctaagtgagacattattaatgaaataatatgtctgaaggtctggtactaatgctggatcacgaatataatttttgaacatgaagagctactaaatgtaactgagtttagactgggaaacttttccagtgatccactaggtactagtttagttgcatggctgaatgacccagctatttgccagaggagagggaaatgatatgtagctgactgtcaaatcatatgctatttattatagttatattttgtttgttttaactcttaagtgaattgtgagtttctgcaaatcagaaaattgtttattaatgtttgtttgtactgctgtgcttaattcaaaaccacctaatgagtgatttttgaaatcaacccaattcatacatgatgggtagatttaaaaaatagttttacattgtttcttatttcgtttagaactgcaatcccgagataggaagattgcttcaaaaactataacagatttctgaaattgagtaaatttgcttcaattgtctattaaaagttttgaagtataataaacaaaaaaatatattaagtaaagcaaggttcaaaatcacgtttccagtaaactttgcatttgcagtacatttatgtagacaaaacaagtccacaatagtttaaacagacattcacagcaggtgattccaagaccatgggaaggatttggttcctgtttattttctgagttgtcttggatgctctccttccagttatgtcttcttctctttctcatgtatcatgtcttatttcaactattctgacagcatgtcaagcattagcagcagaataatctgtatgcacagtgggagagagaggcagaccaaatacacattgaataaggaaaaagaagtttccagcggttgatacattattctccctagcaaagggctagatttgctaagcatatggagacatgcttaaggatcaatagggagaactttgaaatatatgcccatcctgtgaaaatttatatcttgactgaggatatgttttgatagtataagtaatattctcataaaatttttggagtgacacatgagaaatggaggaaaccataatgtaaaaagcacatgttaagtccttgccaatgattaagccatccttttgccttataaagacattgattttcattctatcctgatcttttagagtagttgggnttctatatatcttgagaattcctatgagaataaaacacagctaaaattagtgtaatgagcttaagttagaggaaagcaagataccctggatcttggataaatatacttggtttaacgaatttcttaagatatatccatgaggatatcattttccttaccaaaatataatgcatatctttatttatttgtttttttaacctcagagcttctagggtagactcaaaaaagacattctgctagccttatgttttactatgtttccataaatgctaacatttctttcaaatatttacccccaaggcttattttagatgtatcagctaagggagaggagtcagaaagataccttataatgaagtttcctcttctttttcttatattcgtaacaatccgataaatggtttctgaattatcgagtagacctctgagaactcagcaggtgattccaaatcaaattcacaaccttccaagatgacattttccttagaaaatcccagtatctaaccttaccaactggattaaaatcaaacttctttatgaaaaaatatacatcattaaattgtgaaatcaaatatagctctattaattaaaatgtaatggtaggaataggaaaaagtgttagtgtgcgttgtaatagaaagagatgacaagtgcgcacagctgaggaacgttccttatatttccaaggtctctgtgtcagaagttcgatatcaccataaccttttgatgggtcttagttaataaatagttcgttattatattttattcatactgtaatattgcttttaaattcgtcctcttcattcatggctgtctttaaatcaatagaatcagttaaaatatacagaatataaagtagaaaatacagcgtattttctggttagaatattatgttgatttaagacttaattgcattctgtgaaatttaggtttaatcattccacaaaaaaacacttttagaagcaaaagtgatgattaaagtattcaacaaacataatttaataatattggtttagttgacaaaataaaatgttgttgtgaaagcctttcttacccttgctctaaaaacggaaaataaggctgggcatggtggctcactcctgtaatcccagaactttgggaggttgaggtgggtggaggatcccttgaggtcaggagtttgagaccagcgtggccaatatggcgaaactccatctctactaaaaatacaaaaaaattagccaggtgtagtggtgtgtgcctgtagttccagctgctttggaggctgaggcatgagaatcacttgaacccaggaggcagatgttgcagtgagccgagattgtgccactgcactccagcctgggcaacagggaaaataagaacaaatgtaatcacataatttttttagttgccatagtgggtttattacacaagcatgtggtgatttatatttaatcataatttattgattatattaaaaaatagagacacaatggtctcacagagagggaatgaacatatattattttggctaactatattttatgagtaactgcatttacatttccttggttttgaacttagccatgctatgaacaactgaataatctttattgttatagtttcaaaatatttgaaattatctaatggctcttagattatacaataaaaattataaaacattatattgaaaaaatgtattaatattacaaaaccttacaataaaacataataatacagtgttgttttggcatgtgtctcttttatataaaaatcagaaggagaaaatccagttatttgttctttttttgagattttactaaattacaatgccctcaataatatgaagacatacaatttaccaacaagtggccgggcgctctgtctcacgcctgtaatcccagaactttgggagccgaggtgcgtggatcacgaggtaaagaagtgaagaccatcctggccaacatggtgaaaccttgtctctactaaaaatacaaaaaattagccgggcgtggtggcgggcgcctgtagtcccagctactcgggaggctgaggcaggagaatcacttgaacctgggaggcggaagttgcagtgagccgagatcgcaccactcactgcactccagcctgggagacagagcgagactccgtttcaaaaaaaaaaaaaaaaaaaattaccaacaagttgataatttcctacagaattaacgtcaccctgaagtttacccctttggtattacagctgtttatcatgtacataactccctttttattttgagaggggttaaagttaattcgtatctataatttatagagtaaaattatatttgttaacaaaataaaaactttttataatactttaatgaaaggcttattcaccaaagaaaataataaaaattacagtatctcatcaataatttggcagatatctcaactcttattttttctcgtattttaagactataaattatataaaagtaacagtattcattgctaaacagtaaaacaatttttttctgtgtttacatctagcttactgttttagtaataaaaatgttctcaattttcatgcattgcagtcacatccttaaaaaatctgagatttcttgattttctgtaaatttggcattttagtctgaattattaaacttaagtaaccaggatgtaaacttttatcgcttttttttcatttaaaattaagaatgacatctctctgagtttttatgtccaaaattctggatacttctaaaaggatgtgagcattactgcagggtagatggtaatcctagactttggaatacaaattaaatgagctgttctatctgaccattctctgtaacacagtttcagggacttgaacgacctgatttgaaaaacaagtatgaacagttagacataatgtgatctaaaggtagagtatttatgtataatcttaagttacaaaattatttgctgaaaactttaaagtcatatcgtatcttaatatatataaccttatttatatatttattatttagtcatctgcctttctttccaaaaatgctgaaaaataagtcagttatcttttccttcatttggggaccatgagaattttctctttgagaaatatgtgtttttttttttttgttttgttttgtttttttttttttgnggcagctctgtgagctcaaatttcttaggtttaatctaagaaattccaggagcgttactctcaaccatgaaagctttttgataggagtgaactgcagatgatctggctttggaacattaccagtaactttcaaagaattttcttcatgaaagtcagaatgtcagtgctgttgctaaaatttctggtttaaacatgtttctttttcttttttttttttccccagctgaaaatacaaggcaaacactgccgttcaaaaacattaaaaatccttgcttttattctcatattagggttcaatatcagtggatggaagtaaaatagtgtacacatcactcaaaataatcaatatactgagagctggtagccttactttgagttctcacttctgcttttatgtaagccttgttgcctatttggaatgtttttctacctgatacaggaaatgagaaggtgatattccttccagttgtaatcatccacgtttctatggtgtaaagtcactgtattccttttacccccaacttttactacgcatcaactgcatgccagttactggctgagttcttcacattaacaatgacattaaaatttcaaaatacgcatttgagatagggataaaaatggcagagaaatcaagcaagttcccaaaggtcacagagcccaataagaaacacaaacagaataacataggagtcagatcagtagccaagatttgatttgtgtgatcaccataatatagatcttaaaccaaaactgatggctacttaacttaattttgtgaaaagaatgaacacagagagaaagatgggcctcatacacacacacacgcacacgcacacacacagcatatttaactgcattctactaaacagatactctttcaggtgacaattggctagcctttttaaaattacttaattaattattatttctttttaagcagagtctttctctgaaacccaggctggagtgcggtggcgggatccggactcactgcaacctccacccccggggttcaagcgattctcatacctcagcctcccaggtaactgggaatacaggcatgtgccaccatacgtggctaattttttcagtaaagaagaggtttcaccatcttggccaggctggtttcaaactcctggcctcaagtaatccgcttgccttggcctcccgaagtactgggattaaagccttgagccaccactccaggactggctggcctttcttgatagaacagttaagttttaaaagcaaatgagaaatactctctttttaaaactttccctttgggatgaaattgtgaaattatagctaactaccattgactagacaaaactccaactgtgtttttggctttgcatttgttatatttaatacttgactcaagaaaaccttgtaaagtgtcttttgttattacagaatctagaagccctaagcaaatatatcactctttttctatatattaggagaatccccatttgccctatctgtattttcaaactttggggcttcaaatgtttgaagtaaattaatatttgtattttaatatttacctagtcaattttctaagaaattcaacttactaaatgcttaatgtcaatgtcattcaaacacaaagtatatatactacacttaattaaggattcatttacagagagtcatggaaaatataactcataatttataatttacaagtctcaacattttgcatatttttcaaaagggaaatatatatacatgtatacatacatacacacacatttagatatgaggtactaaaataaatataatgtaacttactaataaaatcaatgtattgcatgaattgtcaaaattctatatttttgctatactaattcaactcttttgtgccacattatgttagagtcacttatttctttatggagctgtcagagctagtttactcagtaaaatactctgtatgtttacagcctttatatgatattatacttaaatcatatgcaatataattcatattatgtgcaatgtaatccaaaygtattctttgaaacatttgtaatgtgtattcagtaaaaatatactgaaataaaaggtaggcacctggcacaatccatctcttagcccttctcacgttgtattgaaatgatttctatccaagtttcattgacctttagtctaagctcctatggggaatttcataccatgcttctacaactaaaatttaaccccatactgataaataattggtggtcaataaatatttgtttcagctggctgaagaagtaagcctttccaattaataataaaaattaaaattttatgggattttccaaataattagaatcagaggaagagcgagagagagagagagagactgagatctcaggcatatcaaccttgtggataaatagagggttatagaaatgaattgacaaacgtgctgtaaattgcttagctctgcgaatctgctaattctcaggagagtagaaaagacttgacatttatcaagtgtgtgtcatgtgaaacacttcgtgcaaggtaattttcactctttattccttttagtaccaataggtatcagatatcactgcacagttagctgcacctaattatccagctaatttttctacttatactttgaaatacgtcactatatgacaatggtaaactgtagcattttcaaattttaccgtatgacggttgtaaaaatgaagtttactacttttaaacattccattttaatttatatatatatatttgttttctgatatttattatcgcatatgaatgattttatatgtgattaatttatataacaaagtacaccattgaacttcatgaatatgaaatcataatctggtatacatagacttttagtaatataacagcattttaggaggaattatattatgagctgagtggcaaggataacaaattctgtcctgttttaattatttaagtcacagttttactagtagtagaaacaattctgaaaaaaaaaaaagaaaaagaaaaagaaaaagaaaaacaaaagatctggtcagatgtgatggttcatgcctgcaattctaataccctgggaagctaaggttggaggttgtagaattgctgaagaccaggagttggacctgggcgacttagtgagaccccgtctctacaaaaaataaaaataaattttaatttgaagcaatggtctgagaaagtgagaaattgtcgacttgtaccctggataattttatgcctgattttgatttttctaacatttcttactttaaaaattatccttgaaaatttcagaagtggcttcacacttaattttcatgatcattttcaatgtttcttccaaaaaatgatctacatggtaattattttatgtggcataattctctagttgaggagacacgatgcttttactccccaaataaaatatggatatatagctctttgtcatatgagcacatgttgcaagaatcatttgatatgtttatgctgaaatagaaccttaatgactcatttatatttccttacatccaattttattctgcattacgaagtgtttaaataatatggtataatatattgtttgagtctagcctctaacatcctgcaaactggcatcagaataatttacttttcctaagatttaatagtcacaaaaatattcattaaaattaaaaacattacatctggaaatacaactttgctgtttaaactgatcattgtactctactttccttttttgtaatccgaatggtaaggtataatttacaagttatattttataagttcataaatgaggagtaaattttgttttataaaaacaaacaataattgttaagttagtatttatcacagggggaaaggccttgattcaacaatccctgccaagttgcaagtctcaaatcctacttagatatatattacttgtttgcgtacttttaaatgtgccttccttcactacagagtatatatgctgatggctttattttttagcacttacattcatagattcctgccatatgattgcattttacagtataatacgaacatgttcataaagatttcatttgaatctattcacagtttttatatatactccatgaaaatgttatacttttaatatcaattatgtgatattctcaaattgtcattgattattctggtccattgttgagagatgttcctcactcttagtaacagtttctacatcctggaattcataataataacaagagacatttagatagtgtgatggttaatagtgtcaacttgattgaagtatgcaaagtattgttcctgggtgtgtctgtgagggtgttgccaaaggagattaacatttgcatcagtgggctgggaaaggcagacccacccttaatctgggtgggcaccatctaatcagctgccagcacagccaggacattaagcaggtcgaaaaaaatgtgaaaaggctagactggcctagcctcccagcttacatctttctcccgggctggatgcttcctgcactcgaacatcggactccaagttcttcagctttgggacttggactggcttccttgctcctcagcttgcagacaatctaaagcgggaccctgtgatcatgtgagttaatattctctaataaactctcctattatctatctatctatctatctatctatctatctatctatctatattctattacttctgtccctctagagaaccctgactaaaacacatagtaacccacagtattatttacccacatatagtaaccattagcttatttaagccataccacaaacctatgatgcagttgttattttccctcatataaacgagaaatctgaggatgacagaagttaagccatttgcttgagagtttttagctaataagtgaccaggacagaaattaacttatctctataaaatgttatttttgttaatattgaatctcagctatagtaaacaggatattttatgtacagactgggatatatgtgaaatgatttacccttatttatattccaggaaagaagaaaaatgattacgttcttctcaggttgttacttcataaacggtataactttttattttgggatattatgacaagaatatttgggctttggctgaagtggaaggacttgggactacatgtcaaattttattttgatagtaaatattgtgtccaagggtgcccatcctttaaagtatgtaaattcagggttacccctctgtgattatagaagacttatatcctgtacttgataatgggaaattaactaaatgattttccatataatgaccattagcttctcaaaggaactaaaaaagtgttaatgagaaaacacacatttttattgactacaaaccataatttttgatggtctcataatcaatttaaatatagaggcatatttataaatatcatttgcatttgttgttggatttttatttgatatattatttattttaatttttttatttcaatagcttttgggatacaggtgtttgttggttacatgcatgaattgtatagtagtgaagtctgagattttaacacaccagtcactcaaatactgtacattgtatccaatatgtcattttttatccctcaccaaacctccctcttctgagtctccaaagtccattatattactctacattttgcatacccagagttcccacttacaagtgacaacatacagtatttaattttccattcctgagttacctcacttagaataatggcctccagctccgtccaagttgctgcaaaagacattatgtttatggctgattagtattccatggtgtatctataccacattttcttttcttttctttttttttttttttttgagacagagtctcactctgtcacccaggctggagtgcactggcacaatctcagctcactgcaacctctgccccccgaggtcaagagattctcctgtctcagcctcccaagtagctgggactacaggcacctgccacctcacctggctaatttttgtatttttagtagagacagggtttcaccgtcttgcccaggctggtcttgaactcctaacctcgtgatccacctccctccctcggcctcccaaagtgttgagattacaggcataagccaccgcgcccagcctataccacattttctttatctactcactggtggatggggacttagaacggttccatatttgcaattgtgaattgtgctgcaataaacatacacctgtagatgtctttttaatataatgacttctttttatttgggtagacacccagtagtgggattgatggattgaatagtagatccccttttatttcttgactaaatctctacactgtttcccatcgagattgtactaatgtacattcccaccagcaatgtttaagcattgccttttcaccatattcacagaaacggctattgtttgttgactttttaatgattgcatttctgcaggagtgagatggtatctcattgttgtcttaatttgcattttcctgataactcatatgtttgttagccatttgtatttctttttttgagaaatgtctgttcatgtcatttgcacacttttgatggtttttttttcttgctgatttgtttgagttatttgtagattctagatattaatattttgtctgatgcacagtttgcaaatattttctcttattctggagatcgtctatttgttctgataactatttctttgctgtgcagcagttttttagtttaatgtgggccaattaatttattttgtttacgtttgcatttgcttttgaggtcttattcattaattctttgcctaggcctatgtccagaagagttttttctaggttaacttctagaaatttatagtttcaggtcttagatttcagtctttgatccatctttaatggatgtatgtataagttgagagatccagtttctttcttctacatgtggctagccagttttcccagcaccatttattaaacagtgggtactttccccaatttatgattttgtacgttttgtcaaaattaagtcagttgtaagtatttggatttattcctgggttctctatactgttcctttggtgtatgtgtctactgtatactggtaccacgttgttttggaaactatagccttgtagtatagtttcaagtccagtaacgtgatggctccagatttgttcttattgcatagaattgctttttttcgggctcttattttggttccatatgaattttacgtttttaaaaagtattgtaaaaatgatattggtattttgatagcaattgcattcaatttgtagattgttttggtcagtatggtcattttcatgatattcattcttccaacccatgagcatgggatgtgattccatttgtttgtttcatctacaattttgttcagcaatattttgtagttctccttgtatagatctttcacctccttggttaactatattaccaggcattttatttttttatttttgtatgtttgcagctgttgtgaaaggggttgagttcttaatttgattctcagcttggttgttgttggtgcatagcaatgctaatgatttgtgtacaatgattttgtaaattgagaattcactaaatttggttatcaaatctaggagtctttctttatgatgtaaaagagaagcaaaggccaatggagtgtcaccctctaagcctacccttacatcccagttacgttgctaactcagaaaaatcagctgaagggcacttggaaattccctactctgacccagatagtcttttgattaaaatcatatggttattagtttttattttccagatggaataaatgaagaccaaaagaatgtttatgtggaaactgtgtttccccaaacccttctgcagtagtcttttcactgctgaaatcgttgatatactaccattataaacaaacacactctttatttgttcacctaacctgcatgcctttattccttagaagattttcaatattttattttaaagcatactggaaagaacagaagcattaaagaaaaaaaataaataaagggactccccccacctccaccaacacacacaggtatcctctttctcaattcatcagtgaggacgcttggtcagtaaaggaatttctcatgatccctcctcctttctctacagggcatagatttgcacacgtgaagccaggcttcacatgactgtattccataatagcacaccaaaaacactgtcaaaatcaatgaaaacttcacaatataaagaatatagctagaatcatggtaatgatcagttgattgatataatattagataagtgcaggatggtaacttttataaactaacttttcaaatggctcagtgaattgtctaacattccatggcaaatttgtatgaagactacctggaactcagctatctacaatttggttggcaggggaactaggtttgtgagtttgtttcccccctctatgttctaatgctcagcaaactgtgaaattttccatgaaatataatagttacgtaaatataaaaaagcaaaactttttggtatgttaattattgcaccaacttgtgttgtttgactactattaacaataaactaaaacaattctacctgcttgattgaagcaaaaatgtcaatgtgtaaggatgatgggtagatcacaaaatcaaagaaacagctacatagtctgactcagacaggacatgtcaaacagcatccctgtaaggaacttagtctacagactcacataggccctgcctcaggaataaataagctgcacgtgtgttttgcttccttgtattctttgatgtcagggtcagatactgggaaagagactcagggcaaaaaaagagtatattgattgacagcttcctcaagacagcccacaatagaaaagacatttcttttcaaagaaactgagtataattgtcaaaaaagaaaatagatactggtcatcaaagcaagaccttatactttgtcaaagtttactttaaatgtcacctcctccaaaaagccattttctcattcccctaaatcattctcagtatatctcagctttcattaaacaagcatgggccatgtatttaagaaaacagaatttacgggaggacaagacagaccagaccttaatttcagggaacataaattttgccaaagatgatattgccatactactatttctgtgattctcttaggatcctgatgccttgtgtcttagttatgttttttcttaatcagaagtttaaaaagtatattatattttattttaagttctgtgatacatgtgcaggacatgaaggtttgttacataggtaagcatttgccatggtggtttgccacacttatcaatccatcacctaggtattaagcccagcatgcattagctatttatcctgatgctctccctccccacaaccccgaaatagaccccagtgtgttgtttccctccctgtgtccatatgtttttattgttctgctcccacttataagtgacaacatgtagtatttggttttctgtttttgtgttagtttgctgaggataatggcttccagttccatccatgtccctgcaaaggacatgatatcattcctttttatgggtgcatagtattccatgatgtatatgtaccacattttctttatccagtctatcattgatgggtatctgagttgattccatgtatttgctatggtgaatagtgctgcaatgaacatatgtgtgcatatcttaaacaaatttgtaagaaaaaaacaaacaaccccatcaaaaagtaggcaaaggacatgaacagatacttctcagaagaagacattcatgcagccaacaaacaagaaaaaaatctcaatatcactggttattagagaaaagcaaatctaaaccacaagataccacttcacaccagtcagaatggtgattattaaaaagtcaagaaacaacagatgctggcgaggctgtggagaaataggaacacttttacactgttggtggcaatatcaattagttcaaccattgtggaaggtagtggggcaattcctcaaagacatagaaccagaaataccattttactcagcaatcacattactgggtatatgtccaaaggaatataaatcattctgttatcaggaaattttaaagcttctttgtgatgtgttttattagttaaaacaataatttattagttaaaatgttgtgtctttcctaacacttaccacatggtgtatcatgcaatgcacactaatgaacgcttcaaaattagccttaaatgcacagtctcctcacttgcactctttgcttatcttgtgtctgatggctcttctgcatgaacaggaaaatctgaattctcacaattatttctaaagcttttattaccttcccttaacccaagcccagttttattacctgtatgacacttagacagtttacattgtaatcccaccctctaatggatttaaactcattttccactttggtatccccatatttagtcattatttgtacttctgttattgcagacccactccaccttgtgttgcagtgtgtgtatctgtgatcccctgtagagtgtgagttcctagagtcagagtatccagggatagctctctttaaacatctaatgggattctatgaacataatgaaataacatttatgttagctaaatgtataaagagaaaatatatacttgcccctttattaaagttgttgtttcatattattatatgccaacaccatactagtcctattgacagagagttatatgtggtatttgtattacctttaaagatattagagcataaaataattggaataaactgttaggacaaaataaagaggtacaatacagacactgaaatgggattggccaattctacttagctggacagaaaagctttctagaatagatgaatctcaaaggataaacggaggcataatccttgcagacaagaagaaaagtgctttccaggtgaaagaagcagtggtacaacgaacaaatatacaaaggatgaggaaggtggagcatccaatttaaggatcaaaataacaaataattaaattaggttatttagaaggtaagatcatagataaacacacacatgcatgtgtgtaatggaatttaaaatcattttttaggtaagaaagattcgttggaatgttttagagggaagaattaagtaattctatacacattttagaaagctcattctgatatcctataaagaatgtgtcaagtgtgaaaattagtaagatgaagagtcagtaatagtgaatctaaaaatgtgaatgagcacaagagattattacatatatatgtgtgtgtgtgtgtgtgtgtgtatacatatatatatatttttaatccaaagcatatggtaactgataacaggcgggagtattagaaagggtcatccaggttgaatccaggatttcatgggagatagaaggaatgaacagtgtttccagacactgagattaagaatgtgagaaaagaagcagttgtaagtgtgttgaacttttgacgtctatacaaggagtctactggttactagaaggtttacaaagagacctaggtggatattactagtctttgtgacattatagtgtactggtataactcttggtgctatttggggttgctaaaaatgaaataaggaagggaaggggacagaagataaaaatggagggaggataaaggggagaacatgagagtggcaagttaaaagtagggcactagagcagaagacagaaggaaagcgaggcatacaaggtaagggaaaggtaagaaggaggcgagaagagaacctgtgtgatttccaacatctaagtgtggacaggagagattgtctgtaaaagggagaagacatggtcacgaggaaagggggtgctagcaaattttcatcatggaagcctaaggtaaaattttcagagaaggatgtttaatgtaagtgatatctaaaatggccaagatcaatcatgatgataagtgaacattcagataaagtttcagaacagataaaactctgtaatggtgacagcagccatcggagtggttacatggtatggcctggggagggatgtggggaatcctggggtgttgaacatggcctatgtctcaaagtggtgaccaatcacattaccgcacttcatgtgctttgctataagcaggtcatccctcgattcaaaatgtgttaaaatgtaatacgaaattaatataacacctaagagggtaaaaaatattagtggctttctcggattacctgggtaccatcagctgaaggattcaaaccaaactctgttagactcagatgccttagctgctgaccgctgtactactctgctgtcaaatccaatccttgccaagcctctccattggcatgttaaatggacttagtctctgttgtcccttttagtcttattttgaaggcacctacctattctaccaactgataaattgaattgttattactgttttacagtaagatttggtcagaagctttggttagaccataattttttgtcagatctgttgttctgaactctccattaaggaactgtttagatattacatatacttttgctgaaattcagaggtactcataaatttgacgacttttaaaaaaatgtactatcagcagtggtaaatgataactaaaatggtataatttatcttaacagtatcttgagcttaacaaagcttcagataaaaacaagattgcattgaatatcatgcaataaaaggaaatacttaaagcaaaggtatttatatgttcttatgtgtatgttcttacagggatggaaaagtctattttcataaaatctaattttttaatttacaatatagagccctttgcttcttttcctgtttaggttaagatcttttcttctcttgaaagattatgtatattttaatatgattaatcttattttacctttacagaagtactgtgaattagcagggcagatattatgacatctccttaacatatgaattaattgtgggctgccaaatagtacatgatcttttactggaacgtagatccaggtggctcaaatagatatttaagggcagagcacctaaactgaccagccaatgtaagcagttcatcttccgagcagatttatttttcactgtaaccaaatgtatttacatgctcctggaaaaagtgttctcccgtgagctttgttagtgtgttttcaccaaggaactgctatctgggttgcccacactgtgtagagtttttgtcctgaaaagctaaagtccatatattgaagaaaacctaccacataaagatgtttcctagaatacccgtcatgatcaaaggtttgcagctgtagtggaactaactaatggatgcttcattttagtaagggcctcttttcttccattgatcatagttgaatattgtggtgtcagtttaagatgagtccatgtgtgacatggatttaaatacccaaatttcagtggtttgataaaaattataagaaatactgcaattatctcaaactaaaacttgtcaagatttgtgtaatatcatagaatgtggacaaagtgattaaaaaatatattctattgactctgtgacataattttagcagatacatctttatattggccaacctttctttgaattaatcttgacttacgagtttagaatagtgtcatgtctggagagaaaaagacttcatgtgaaatataaacactctatgtactattttagtattaattttagaaagatatttggcacaccttgaaacgtgatctaatatcactttcaattctaagtctattgcatcatcaagcagaattatataaactatttttaaaagtttatcaactggattttatgttattagcaatacatgagatgtcatggctttaaaaggatggctattttattatgtagtatccttcaaatattattttagtagttttttgtactaaccataggccaattaatgattcagaaatatatttaatttctattttataaatcttatattcatggcaatatactacccctcactgatttttgcttggctttattaaactgagtttctgttttatctctgcaaaatataataaaaaataaaaatatgctcaaatattaagcaccccataaatattaggtggataaataaatataaccaaactgctcttgcaaaagtgaaaaagttttaaatatagagatttcattccattccctttaatttttcaaaatattagatgatacaaaaatcatgtgcacaattcagactcatagctatttttagaaactataatttttgattcaaaagaaatctgcaatcttgcaaaaatgagactcagtttaacagtgtatttccaaagaaattgtagctgttattcttgcctttcttcttagacaagagacttgtgatggtatctcttaatattccatacgtaacaagaaaaagagcagaaaaagccatgggaactataaatataggcagtgatattgtggtattgtggttgaaaacattatctggaagtgagaccacaacaggttctcgttctagctctccatctaacttccatctctagagatgtgcccttgacaaaatgattttttcctctggactttaatttctttatctggaccaggtaagctcaaagatctcagtttagtatttgatttttccagattaaaatctaagatgtggtatcagatacacttttctatttttcttttatttgtcagacaaacaaggtgaaaatgtgtttaaaaactaggtttatccatttttttcctgtacagtgttcctaattcaacactacatttttctatatacttttagtagaaagtgaatcataagttacttcagtaggatatatctgttgttttgctcttgtactcttcctttactattactattatttcataacataaataatgttaagagatctgggtctaaatgtaggatttaatttttcaagtttttacaaattctatgaattccctacagtttctttggccgtcactatttgtctggttgtttatagaagccgagaagcagaacccctatggctgaagactggtcctgatagagattcttcttctaatcttctcaaaccaggaaggtgttcaggtcactctgtaaatgattcaaagacagatactatgtaaagttacatttttcctttaaaatccagtctgtaagcaaattttatgccttattttaaataacaagatatgtagctttggcaacatgtcatcttatttggataggctatgccaacaggacccaaccagagcaagccaaaaaagatctttgaatgacagacagcttaagaagaacagaatctgttagagaaaataagagaaaaggagaaatgtactgagcagaccaaaaaaataaaataaaatagaataaaaggagcttccacacaaggctgttgggttcattcaccacataccaagggaacactaccaagtaaatattataaataaaatacttgctggagaaactgaatatccacctgtaaaataatgaatcagaacacctacttcacttcatgccatatacaaaaactaacccaaaatagatcaaagatctaaatttaataagtataaatataaaactcctagaaagaaacataggtgaaaatatgcaaaagtttttattagggaatgagttcttatatatgatgccaaaagcacaagcaaccaaaggaaaatcgataaattagattttatcaaaattaaaaacttttatgcattaaaggatactatcaagaaaatgaaaagcaagtaacagaataggagaaaatatttgcaaacatatgtctgacaagtattaagtatctagaatgcttcaagaactcttacaaatcagcagtaaaaacacaattcaattaaaagatgagcaaagttcaatattaagctattccccagagaagatacacaaatggccaataagcagtgaaaagatactagcattagtcattagagaatgcaaatcaaacctacaatgaaatagcactttgcacctactaggtggctataattaaaaaataagcaaacagaaacaaaacaactattggtgtggatgtagagtaatcggaatcctcatacattgctagtaggaatgaaacatggtacagccactatgaaaaaagaaatgttttcagttcctcaacaagttaaacatagaattaccatatgacccagcaattccgcagctaggtaaatgcctgagagaagtgtgttagtccattttcacactgctgataaacacatccccggggctgggtaatttataacataaaagaggtttaatggactcccagttccacgtggctgaggagggcctcactcacaatcacagcagaaggtgaaagacatgtcttacatggcagccagcaagagaggatgagagccaagtgaaaggggctttgcccttataaaaccattgagatctcatcagacttattcactaccatgagaacagtatggagaaaaccacccccatgattcaattatctcccaccatgtcctttccacatgtgggaagtatggtaaccacaattcaagatgaaatttgggtggggacacaacaaagccatatctgaagtaagacaaattatctcacaaaactatacaccaatattcctagcagcatattcattataggtaaaagaagaaaaaaggcacatgtccattatattcatacaatagaatattattccatcataaaaaggaatgcggtagtgttacatactacatgatgaaccttgaaaatattatgctaagtgaaacaagtctgacacgaaagaccacataatgtatgattccatacagaagaaatgttcagaacaagtaaaggcacagaggcataaaatagattagtggttgccagtggctggcgggagatttccattaacagctaacatgtacagggtttctttttgggttatcagaaaattctggatttcatatttattgttgcagagcatagtgaatatactaaaacaaacaaacaaaacactaacatatactcttgtaactggtgaattttgcttatgtgaaaaatatgtcagtaaaaatgctaaagtaaaacaacctgaagagttgactatatatatttgtagatatacacaagtatgcatttagcttttataaacaatgtcttgttaaattattactagcaattttatagtcagttaagattgaatacatgtttaattcctgcctttattgaatattcattctgcaactacttgtgctgggcactgtcctaggttcaaataatttaacaataattaagagagacatgcttcttctagaaaagatcaatgatttgaaaacatttttatttcaggacacttttatactcttgaaaattattgaggaccccaaagaactattttttatataggatacatccatcaatattcactttattagatattaaactgagaaaaaattttaagcatgtgttgaaataataaactattttaatataaataatgcatttattaaaatattttctattagaaacattttagagaagagtaaaattatttcatatttttgcaaatattttgacatctgactgaagagaagattttcagatttttacatctgctccagcatttagtctattgcaggctcttgttttggttaaaatgtatgaaggaaattttgccttgcacggatatggaaaagagaggagtatttcaattaccttttcagaaaattgtgaatatatatgtatatatatgtgtgtgtatatatatgtgtacagatagatagatagatgatagatagataactacatcagcactaaacaagtggtaatttcttacatgtttgttgcaatgtgtaatccggaactgtatcagtgaaattcttataacctgttacattaaaattgattggtcgttctttcactttgaagagatcttttaatcaaaagtgattttgcagaattttgcattggtcatttggaaaaggtttgttcatgaagctttgcagattttccaattgttgatacattttatgatacaaataacacttgttaataccaccactgttctcaaaaggagttttaagtgtggaagccgtaagctgccaagctaatggtggcacacacacgttttccgaaattctgcttttcacttgaaagctagaattttataatgaataacaagtactgtcagatgtttcccttagggtcactttgttcatgtttgaaaaagaaaagtctgccaaatgcctacttatgaattaccatggtttgtcagtcattctctcaattagaagcgaagagctaccaaaaagtgggcagcgaactctcactccaacgaccgcatgagcgccccctgccgtcaactgtcacgctgccgtgcagcagaagtgctggatttcatctgaggatgtgaaaaaggcatgtactcaggatggaaattccacataatgaacacttttcgctgcttcatcaaggacgtgcttaactaaaagcagcatcgtttttggttgtttgtttacactgggtgtgtagcagtgaagacttcagtggcacctagtgcggtagctcctcgattcttcatctgcactttcgccattgatgcgccactagttttgctccccttatgcaatgttagcacagtgaaaaagacaaatacatttcgttttgttttgttttttttgagatggagtctctctctggcgccaaggctggagtgcagtggcgtgatctcggctcaccacaagctccgcctcccgggttcccgccattctcctgcttcagcctccctcccgagtagtgtagctgggactacaggcgcccgccgccacgcccggctaatttttgtatttttagtagagacagggtttcaccatgttggacaggatggtctgcatctctttacctcgtgatccgcccaattcggcctctcaaagtgttgggattacaggcgtaaacgtttcttaatattatggcaataaatatagttttggctccagagtccccctaaaagtgtattgggacacccagagacctgcctgagcaccataactggataactgctgctctagattctaaaactttctctgagttgctttatcaattgtccttttcttgttttcttacacatgggagattcttcctcattgtctctgaaaatcctcatgtttcttatggttattttatatggcttcatgatgcacacacacatccttatatatattttcttccgaatcttctctaacatgccctcttcttgcctatagatcatgacagtattctacgtacatattttgaggagtttttattatgttcactctgggagagctttcgctcctcagggtacaggagacttgtgaaccccagagtcagtggcagtgcctgcactccctagcttgctgctcacatcggtagctgaaatgccttagtcttgcttcagttatttcctttaaatagatgctaggtcgaataggtgttgtggcctcttagtaactgagtgatgggagaggtcatttctttgcttataagaacacactgctttctaagtgagaagagcccagcttcctgacagagcaccattagaagaaccctccactgtccttgttaggttatagtgcttatcaatttctctcctttacagggcccaatccaatgagtgacctgttttgggaagcaaacatgttaaaagaaaccctacttgaaagttaaagactacaattgcattttagaatatagactagtgctaccaattgtgattgtcctcctgaacgctatgcttttgtgacagttaatggaatttaaaaaggaaaagtaaacgtatctataacctaacttttgtaatggaaaggattggattggaatggaatcctaatacattatttctctcagaattaagtccattgttcttaacctgttattcttcagtgacctcgcaggactgcaagctacctaaaactgaatgtaagattttgtgagttttttttttttttccctgcatgatatatagacatatatacactggggaaagaatatcaaaaggtacatttgttttattcattcaaatattaaatatccaaatatttcttatatacacaggtataggtatttagttattggatggtaaaatatatatatttttatatgtatgttttggtcatttcacttggtaaaatagagcatcagtgtgcactatggacagaagcagtaccatagttttttcctcttatatcaacttttcttctcattccctcttttttcttctgatccatctccttcccctccctcaattccagtttgtttttctcttttaaagttggctatggacagcaaagacaagtgaaatgtaatttaaaatacgcacatttaacatattctatattataaatcatgctgctataaagacacctgcacacttatgtttattgcggcactattcacaatagcaaagacttggaaccaatccaaatgtccaacaatgatagactggattaagaaaatgtgtcacatatacaccatggaatactatgcagccataaaaaatgatgagttcatgtcctttgtagggacatggatgaaattggaagtcatcattctcagtaaactatcgcaaggagaaaaaaacaaacaccgcatgttctcactcataggtgggaattgaacaatgagaacacatggacacaggaaggggaacatcacactctggggactgttgtggggtagggggaggggggagggatagcattaggcgatatacctaatgctaaatgacgagttaatgggtgcagcacaccagcatggcacatgtatacatatgtaactaacctgcacattgtgcacatgtaccctaaaactttaagtataataataaaaaaaaattcttcattgacttacatgcaatgaataatttataattagcctatgttactattcattttccttttatttttttcttgcaaaattatgttagaactgtgactgaaatgtatgagtttctcaatagatgctattgattgagttattttgaagcacaaaaataaattgaattggttaatatacactttgtaggtcaaaactggccctgggaattattttttagagctattccacattattcaacttcgtaagcttactgttggttatttatatatttttaatttttgaattataatagaagcagtttaggacttaaatataaaaatatgtaaaatgtaaatacactcatttttcattttaaacacatgctttcatgtcataacggatcccaaaataccaaagatattaggggaaaaaataaactgttgttgtcttaaaatacattcctttgttgaattcatcctgctaaccctttagggtattgacagcctattatttttcatatgtgccatctttatctagaaaactgagagaacaactaattatatccttttgcaaatgagtgcaacagaatggcttttgttcaacacaatttttaagtctgttgaacaggactgttgaatggcttaaaaatttgccatggggtgtgtgtgtgcacatatgagaatatgtatgttaatattcagccaccttagtgtcatggaaagcgtggcctggggatttgattatacattgtgctttgtcataaatttaatggtttctttgcaacattattggagggagtatgcctctatgtctttcatttagcttgtatatttttggtatgatagacatggtaattactgctcttaaagtttgtgcaaatgccactgggaaaggggataggagtaaagaattaaagtgaaggtcatgaaataaacctattaacaaaagcagagtgatttcttgaataatcccttcatctctccccatgtcataatcctttctcataaataattatacaagcaagcctagacacacactagtgttgaagaattgtgctgcaaaatgcatttagctgcattaaataccaagagaagccttgagttccaaaacctccttaaagtggaattctcagttgtttccagagaagaggcaagttatagtacatataatctattatgaacgtatctgagtagaacaccatgcaataaggcgctattgaattgggagggaggtatcagagctaaagagcacaaagacgggccatcgagatattagaggagatttctcttcatatgtaattctgctttacatgtttcctcaatcttatttcctttctccctaccgcctcttttttttttagccacaaatcattgcgtttgtacagattacaggaaaacactcaaatattgctcgaagaagcataatctttcttctgcagttggtaataaatgagatctacttgtaaaaattagtgtcattgtctacaacactttcagatgactctcatgccaccaggtcaatattcctgctagggatgagttagttcttacacttgggtgatcaccaagaatgtgggactcataagggcaatggatgatgcaggcgcatagtgtcctttgatgttactggaggtgtaaaatgaaggttttttttcattctaaatcaaagtttaatggtatagtaagtatttattatctttatcctggaagggattttattgcttttgacatttttaaaaatgtcaaattttaattttaatttaattgtttaaaacaatttttaaacttttatatrgttttacaattcagtggaattctctcttctttatattattgtacttgcattaataatattttagatgttttcaatcatgagttattgtcactatgttttattagaaatatccttctcactatgagataaagggacgaaatgagtgctaatgtaattctacaggggtcagatagcatttccatggttacattgattcactagcagcatgtcctgaataactcctgctgtattgcaaaccccttgcgggcagggtctagtatatttttaatgtttctgcatatagctccaatttagctccaattttcttcctacattgtagtactagatcaaaaaatacttattggttgaacctataatgtatgctacttaggcagctctggcatgaggcatgacattatattttaaataaagaaacacattccagcattccaaaattctcaaagcataaccctgtgtaaaaccatagttaaagtttcaaaatttgaaacacgaaaactgactttttaaaatgttaaccatacaatgactaatgcagtgtgctctttgcacgtgcataaacaataagaaacattattaaaataaaatatttatattttaaagtaaacatacactatttaaaatactgagcaaacatttatataagtaggggatttatataaaatctgaatgatgaaagtacttaaaaagtactaatagtaactaatttattgaatctttgtggcagtcttcatatgaataatttaaccaccagaatagttacggaaggtaggtacaaatgaataacccatttgtataggagtaaactgatgcctagaaagagaaagtcactaattcaagctcatacaacgtacaagtagaaaagtgaggattttagcacaggtaatcttgatacagaatgatttccattatttttaaataagagtaatacatgtatgtatatgaattcaaataatacagaatgataaaaatggcagaatacggagcccccttttccacccctcgagttccttctccccaaccaatatttatattaatagcttattttatttatcttaaaaatattatattttacactcattatttctatctatatctctatatagatatatatcttcatcattataaaataagatatacagtgataaacctttctcttaatatgaatggatgaactgatctaccatatattattagtagctatattgaattccgatgtatggatgggcctaattatcttttttattaataaaattttagtttgtttatatcattaatattctcatattttgctatttgcaaaatatgctggaataaacaagagttaattttatttctatttactgtaaattgtgtcattattactgaagtaaaaggattgagatgacataatgcctatcagtgcctttaaaatatttcaataacaacaaaaaagaaacctctttcaagtgtgcaacatcctgataattaacttatctgggtaatgagtgtatgaaagttcattataaatgatatttctatgtgtgtgtgtatttagaatttttacaatagttttgtcaaaagttattttttaatgaagcatctgatttttagggagggatctaagctttccacacatgcttctattctccatagtagtgtaagaatttcaaatgtggacacgttaaagtatttctagaggaggattaagtgatatgaatgaaactgttggggaccttacattttatgtgtaatgagagctgaaagggggttctacaaagaagtgtgataatagaggacagatttttggaatgaggtaatgtcattccaataaggactatatttatctagggatattttgaaagaaactggtgatgaggagaatgaagagaaatagtcattagtgcaaacatgtcaagaaagaaaacatattacttctttggagatattttctctctctctctctctccccctgccttcccctgtccctctctccataaggctctatttatctatccatcatctctgcatatgtctttatccatacttatatctccatactcatatctataccgatatctatatttatatctgtaagctgatcttagcctactcatcatggtaacatatggcagatttgtgtatacctgttatcagttcccaaatctttacacacacttctctgtcatcatgattaaggggagtaatgtgctcttacgtttttgagaattgggcccaatggggacagctatttttctctgttataagattccatagattgtggcaacaatggcaccatgatgacttctaaactcttgatgggagacttgcttctgtgacttaatggattattagccctgcaatgggaactacacacccaaaggccaagaggaacatgcaaaggcaaacagagagacaagagagcccatcaatcacgagaagatggcaggaagttgtgccgttcccattgcagttattcggacagcttaagattgaaatataatagaaagttatatgacgtactctacagacaagtttatattttattattattattgttttgtaatgtagaaaacatctacccctaaaaatctgtggataataggttactagattttgtaactaaataagataatagacaaaatataatagatatagaaaaagtcagaaatgatcctcatccattttagaaacccaatcaatttcaatttaatccaaatctcttccttcttcaacaaggcactacgttatcctcatccttccagctttccttcccacagctttgatcattcagggttagtcttcattgcccatacttgttcctatttgttttaaataaagtcttaataaattcttcctattgggtggtaataagatatattcaataaggtgaaatgtctaactttaattactgaacaatgaagcatggtagaggtttatactttaataatataatttattaattatacatcatggtccaagggctctactttaattaatattttccactagcaaaaaataactatcggtgtacaaagtcccacagattagacaccagaaccttaggcaggtagtaagcccccagtagttcagtggctaaagtgggctttaagtacctaaggtttatctttattcatgtgaaagttttctggctagagagttaacagctgagtgcatttttagtaaaatactgcaggaaatggctgataaaagtatcaatgttgtatatctgcttaaaggagatgcatatctgttctttctcaaaccactgttaagctgtcacccatagacttattgtagaaacaattatctcacagtagttttatctccagacatttttctgcccagacaaaagaatctatggaagtagtcatttctctagtttgttttagggaggattgtgttggttctcctatgagaaatcacttgcacattatgttcaggtatacaaacacgtgaatgtatttgctatacagagtccatttcttacacacagcaaggtatagtttcaaattgctgaagccaaataaaccaaatgggaagaaattgatggtaaactttgtcagaatgttggttctctctcatatttatgaatctgtcaaaggatagactttttgtaaactaataggtttttatatgttctaattatgcaaggaaatctatcctgtcttagcaatcaagtggtaagagagaaacatatggttagagatcagggaagaatatgttaagtgaataggacactgaaaaagtctgctgtgaatacagtggtgggcagccattgtgagattaagtagtaaatgcccatgcaaacagaaaaaaaaatggaattgtaatataaagtcacaaatataatttgttgattgacttacacggattacaaatttggtatattgagctttccgggcttagtgaataacatcactctttgcatttttttgctacatcatctggccacaaaattttaaagactatttatgaaagtcaagttaatatttaaagtcacaaagagtcctagaaattttgaacatcacactgacttcgtacctgttgtactatggcatatgtctttagtcaactaattatttttctcgttaacaaaaaaaaaggaaataaaaaatcccaaaaaacaaataacccaataaaaataatgagtaaaatatcagggttgatattcctcaaaagaagacatacaaatgaagagcaagtatatgaaaaaatgttcaacatcactaatcaaaaatcaaaaccacagtgagataacagctcaccccagttagaatggcaattctccaaaagacaaaagataacgtgtttgcgaggacgtggagaaaagagaatcattgaacattgttggtgggaatgtgaattagtatagcctttacgaaaaacagtatggagattcctcatgaaaacaaaaatagaagtatcatttgatccaacagtcctactactgggtagatatccaaagaaaatgaaatcggtatgtcaaagaagtgtctgcgcttccatgtttatgacagcattattcacaatagccaaggtatgaaatcaacctaagtggacatcaatggaaaaatggataaagaaaatgtggtatgtatacacaatgcaatactattcaaccataaaaagaatgaaatcatgcgacaacaccaatgaacctggaaagcattatgttaagtaaaagaaaccaaacataggaaaacaaacaccgcatgtttcactcatgtggaattcaaatacattggtcacatgaaggtagagtacaatggtagctgtcagaggctgggtgtttaggggagaaatgggatggagagatgtcggtcagagcatacatttacatttgatagaagaaatgaatttcaagagatctattatatagcaaggtgactctaattaatgaaaatatgattctattcttgaaaaatgtagaatgaatgtaatatgccatcaccacagaaattgtaacagtgcaaggtaatgcatttgtgaattagctagatttaacaagtcaacaatgaatatacactttataacatcatgttgttcatgataaaaaacatacaatgttatctgtcaattaaaaaaatatctaggaagaatctgtacagaagattgtgggtatttataaaatgcatatttactttgtaagtcaccaaatttgtgaataacattattggatttattttgcttaatagaatagaataaataatagaataaattataattaaatatttaaagtgatccctttagaccttgatgattttataaatataggtgagatgctagtttgcttaccctaaatatctattttctgccccagaaacaatcctttaatagaacactttacctttccttaacttccatcaccaaaattggcaattaagaatattttcacacagaaaaaaccactattgatatgtgtgtatttttagcaagaaagccagttttttgagctgtatgatggagccttttcactcattagtgatgcaactgacttctgcacaccatcctacagaagaagaaactcatgttcgtatataagcaaaatgacatatcattacacataataactcattgtggtgggttctaagcaagtgaagcagtactggctaaatccatcagtgtagtattggctctctattctacctgttcttaaaaccagtaaggtagagttcccgctccttgatataagaataaggattccaccttctcctgcccctcccaactagaattctcaaatgtgtttgtcggtggctcatccaatattgcccaaggaaagtgtgttttattagcttgggattccatctgtgaagactggcatttctatcttactaacagatacagaacatatgaagaatccctgagttcctacatagctgtcaagaagtaaatgaactgatttgactgttattcccttcactcactggaaaaatagctcttcccagaatcaagtattgttgactctgttccaatcctcagagcaattcttgccaaacttcttttgagaggtgctgccttgagaaagcatgacctatgaaaatgagttgaagctccaaaccagcccataccacgtgatttgcatagtacaagcctcactgatgatcactatccaccatatcttagagatgggatttagaagttactcatctctggagattgtatcccagggtctagcacaagtctctacacaagtggtactcaaagctagcacttgcattagtattagctgagaattttttaaaaaaaaatcggagaacgaagcaatgaagtaatagtagaaaattcctcttcatgtgaaattcctgctaacatgttgtacagcatgttaggatggggaccacacctcctttttactcacccattatagcccaacgatggaacacagtgcctgacaataagtatgtgttgagtaaatgaaccgctgtgatcctcccactgcatcaccgcaagtacctttagaccccaaagagcataatacagatatggtttggctatgtcctcacccaaatctcatcttgaattgtaatccccagttttcttactgggttcagaaagagaagtatttttccccacatgtggaagaagggacctaatgggtaactgaataatgagggcagtttcccccatgccgttctcgtgatagtgagttcttacaagatctgatggttttgtttgttatttgttagtttgttttgagacacagtcttgctctgtcacccaggttggagggcagtggtgtgatctcggctcactgcaacctctgcctcccgagttcaagcgattctcctgtctcagcctcccgagtagctgagactacaggtgtgtgccaccacgcccagctaattttatgtattcttaatagagatcgggtttcaccgtgttagccaaggcggtgtcgatctcctgtcctcgtgatccgcccacctcagcctctcaaagtgctgagatgacaggtgtgagccaccatgcccggctgatctgatctgatggttttataagcatctgtcatttcccctgcttgcacttctctctcctgtcgctgtgttaagaaggttcttgcttcccctttatcttttgccatgattataagtttcttgtggcctccccagccacgtggaactgtgagtcaattaaacctcttttctttataaaataaccagtcttgagggtatttctttatagcagtgtgaaaacggactaatagacaaagaaagcctcaaggaaagaaaggtacattgtagaatatcaaaatatctcagtaattctttttcataggaaacgtggcttgatcatgtttgttcattgagaacccactctattggctttgtatcttgcttcaagttgttctagaaattccaactattattgaggcatttgcgtattaaattactttttagaaatctttacagtgaaggtgaatctggtaataatacgtaacaacattatgctaaccactttaatgttctagatgtatttgataagaaccttattctcagtattctgagtaaactcggggcctggaaaacatttagcctgtacaaagatgtatatttgttatatttttcttaattgaaagacgatatatattttgaaaaaaacatttagtctcctaaaattataaaaaaatcattgtttagagaatgcaactaatctcaaaattttaaataaataaccagtgcttatagtgtagttgtattatccattcataaaattgattgcaatatgttagtgctggcagcttagtataacacattttcccccgaaccacaaaaatgtgtttatttatttattcattttaaaactactttatagtaatatacagattaagtaaacattttagtaatgagcttacagattttatacgatcatgcggttttggttttcttactgggttcagaaagagaagtatttttcagtggggattgcctagctgcaaccttgacattttcactgtcttgctgcagggagttcaggagcatgtataagactattctatttaatttagttttacaatctcattgtatctggcaatttaagacatagaaaagtaacttttccttaattaaaataaacttttggtatttggatagcaggataatgaatacccagacaggcagtatgtggtgatgagtagtgcatgaactttggaattcacagaccttggcttagatttcagattctccaattattagctatgtcagttagggcaaattgccttaattctttaaactcaatgtattgatgtggaaaaaggggcaataaatcctatcattcaaagttgtaatgagcagtaaagtatatgaatatgtaaaaatgactaggctagtccctgactatgggacatagcatttatttccatgtgcactttgtgtgagggagtgtaatatccaatttctgtattatcatactgcaactatgaatatggacacaaatacagatacatctttaccatttacagactacttttccatgtacacacacatagccctttgctaaaatgtgatcatggaattaggatttcataaaattgaattataacattggaaggccatgtagcttaagattaaaaacatagaatttgcagacagacacaatgagctggaattctattctacttgtttcctgtcctatcttgagcaagccactcaacattttcagtctctttctttttcatgtaaatgtacatatccatgtcatagatttgtgatgtctattaaggaagatgtatgaaagcactgtcacaatgaccaataaaaggagaggattcaataaatggtcattgtcccttaacagatgtctttaaaaatatattaaatttgaaacattgtttcagagtgtcttattggatgaaatgataataactgtacacatgggtgaagattagtgattggaagtcaagaatttttgcttcagctccttgaccttgaggttgaaatttaagcctcctcatctagtttttttaaaaaacgtttctaacagaaatatactttgtggatcattatacctcattctaatccagctccctcaagcttaatctgtatgaactttggggaaaagataagcactgtgaataagttggcatgcttgaacattctttgaataagtagaaaatattgctctttcattttattgacagaaagattatcttgatagcttatacttctgtttttaatgtaaataataggtatcaaattctaaaattgaataatgttgaccaatttaatgagtgtctgtaataaggggaatttataaatgttttgcactaattgcagtttgtaaagttattgaacttccttttatacttagatgataatttattatttatttatttatttttgagatggagtcccactctgctgcccagagtggagtgcagtggcccgatctcagctcactgcaacctctgcctcccaggttcaagtgatccttctgcttcagtctcctgagtatccgggattacaggcacgtgccaacacgcccagctacttttttgtatttttagtagagatgaggtttcactatgttagccaggatggtctccatctcttgacctcatgatctgcccacctcggcctcccaaagtgctgggattacaggcgtgagtcactgcgcccggaccaattttttatttttattgacaatgctgctttggataaagaaagttactgaacgccttggtcaatgcaactgtggtaaagagaacagaaatgatcatgcacaatagcaagatttcagttaaggttcttggttgcaagtgataaaaatttaaagcaggaaaataatctattagaaggctatggaatagatgtcagagacaaatgttaaggttctgaaattgggcaataagcaaggaaggaaagacctcaaaggcattaacctgcagtgcttctgaacgtgggctctggagctgaagttccaaatcttcgctccaccacttaatagaactttgtgacttcgggcaagtgacttaacctttgtatgtcccagtattcagatcttcaaaattagactacccttacagctaactgagttaacacgtgaaagacacataatagatcttcaaaaatgtccagaaaaaaataaatgtggccagaacaatggccatcacattatacaccatggactccactggacgtggttatggaaaactaatctcgctgtccttttgaatttgcatacctccacaaagttcctgacctatattggattttgccttggttgagaggagaacagaagggatgaaatttctttactttttctctaagtgaaaggtataattccctgaaactaagaagaggagggatttggatgttaaacagccacacattttgaaaatgtccactacagttagaataaccatatatcctagctaccttgagaaagtcccagtttacaactgatatcccacatggttaaacacaccttcgtggcagaagtgtcacaatttggatgataaattatggtcactgtgattgtcattcactcccttttgctgctaaaatgtgcatatattcttcttcttatacttactggtccagtgaaaaaagaccttaataacaaaattaaattttcatttataaaaacaataatgcatttattcttttcagcaaacaaaacaaaaacacaacaacaacaacaacaaaaaaccagaaagtccaaaatactattattctgctatctctaagtcttggatatctgtggactattttttgactctaattttttctaatcctatctcagtatttcatcacctacagagtaaattagcatcgtccccacaacaataccctacatacggtatctatatctatttatatacatgtatacaaatatatacataaatatatatatgcatatatacatatctatatgtatatagatagatgtagatatatgaaaggtatatctatatacagtaggcctccattacctcagagacacatctcaagaccctcagtggatgcctgaaaacgtggatagtgccgaaccctatatatactatgtataatttttttctttgtcaccatttcacagataaaagattcattttgctgtatatcttagcaacctcagcatatgatttttttccctttctttattaagtcaagaacttgcatcattttccttaatggaagcactttacagcttctgtttggcatagccaaatggccagtatcactgcttttgtgctttgaggccattattaagtcaaataaggatgacttggacataagcactgaaatagtcaatctgatagctggggtggctagtgagtgactaatgggtggggagcagagacagcctggagaccctgaacaaatgaatgattcatcccgagtttgatggagaaagagcacaaaacttcatcaccatactcagaacagcacacaatttaaaacttatgaattgtttattcctggaattttccacttaatatttttggaccatggtttactgcaggtcattgaaacctaaaaaagcaaaactttgaataaggagaaactactctgtgtgtctacatgcacatgtataagtagtctctctttcacacacatatacacatacaggaaaggaagagaagacatgtggattctagtttcctcatttccatacttgattatgaggccaaattgagtatttatgacttgcctccttcatgacccagtacatactccctctactttcrgggaacacttctgtaatatgctagaattttcatgcctaaagattctaagggtttttctttttacatatagaatgaaaagagtctttcattaacttccaattaatgaacatgctggttctgtacaccatctaccacccagaacgctgatctttcaagatgttgtttcccatctggcactatagtgagttttccatgaatcatccagtattccacaagggctacacagtaagaaccttgaatcctatgggaataagctcaatgcctaacatcgtttgcattatattctttgtttagtagcaatgatatataaaagttgtggttatagagtttgttgaaaatatctgaagaaggtacagacagcaaaggcagacacagaagaaaaatatatcaattttttaacagcagctgttctactgaaggcaaatcactgcactctccatgattcaagaaatcaactaccacccccccaacccccccctcaccacacacacacgcagtactatttgctagcatcagtcttgctcctctatcagggcctctaggttgtgctcagtatgaatgaattagacactcaggggtgccattagcttggcaacctgtccattttaccatgtcctaggcatgtttctatccataagacctttgtcacttgacttaataaggagacacacagtggccaggaaaagagatatttcatcacagaacctgctgccatgttgcttagaaggagaaggagctagatatgtgactatgtgtccattcttgagccctggcacttgggttgtcttgatggtcaggaacttggaaggaagacaattgaaatattgatgacaagaaaatttggggaagagacatgtggctataactctcagaatgaaccaaaacttgaagatatttttggatgtttaaaaaaggatgacctcagaataggaggattttaacaattaaaagaataggatgacttgttttgtgggtgccagtcagcctctttactcagtcctccctgtcacttcccattgggctcatgactaaaatagccattgtgtcagggatggaggttacgcatgggctcagctacatggacttacactcaccaaggctgccttcctactatcagtctaccagctgtagagaccaacactgtgcacccaatgtgacactattccccaggggatcaggcatctacctggtggcaggcagatcacagtggacagcctccatcatggaaagggaagtattttgtttctactggataagattttggatgtggatgtgtctgtcctgaacacaatgcttctgccaaacacggacttacagactgccttatgcactgtcgcagtattcctcacggcatggcttctgatcaaggaactcacttcacagaaaaagaagagtgccaatgggccatgctcatgggattcaccggttttatcatgttccccaccgtcctgaagcagctggcttgatagaatggtaaaatgaccttttgaagacagctctagccccagctaggtaacttcacagggcgggggcgagggtctctagatggctgtaaatgctctaaactaactatccgatatatggtgtcattaatttttatccaaattcatcttcttcacctgtgtattatcaatagaaaatagcttaatttgtcaatctatcttgggtcaaagtttaccataaagcttttcatgaattttagtttcaaaaatttacatcttatgtaatagtgtgtatacatttatatagtaagaaataatatagtaaagaaaatcttaaacacatggctaagtttggcagaatgtcataaagatcacattgtacaacaaatgccagaaattatagtgctgtccataattttgtttctttgagactgattccactggttttcaaatattgctacagttgaaacaaaattaaaagaataaaaactcagaatgatcacatagagtggctaaattaatgatattcaagttctgtttcttcatctttataatcacggtgttataattgtttatttcaaatcaaccgctcaaacacaggaatccatagcaccaaaaatttttgatacagaaacttcactgagggcaagcctaaatgatcccaaatctctatgaaccttttcttgaaatgaatgcatgtaactgagtccgtgtttgtcaaggccatttgtaaaactggaagttctctaatttaacatccatgtaaaatacaatatttataaaacaacttgtaataaatgtatgttaatttgatgttacatatatatgtatatatncaattacatatatatatatataattaaattcaagagaaaccaagtgattgtttaggactgagaccaataaaatatttaataaaatatttttggagggaggacttgtaatcacgaactggggggaatatccacgggcaaaccatgaaccagattcaggacaatgtcgttgtcctctgaatcccaggtaagtccactttgactcttaaatggcagaaggactctgggttttcaaaacccataagcctgttatctaacgtattttcgtttcaccagtgcacagctcctcttgtttatggatgcagatgcctttccagaaggctagaaattatagaaataacatttggtattttcagagtctgtatatggaagtacctacctaccatgtttttatttaaagaattttgaatatgtgatttgactcaaatttgggaattgtgtgaggaacaaaactattttggtggcttcaattaggtctatatgcaatagaacgtgaatacttttcaaaaacagaaatagaacagtgcctacgtgagctagcaccaattatggtccttggtactccatggcctatttacagctacattaatccatgagtcttataattcaaatggctccagtggctttgatgttcattagggacacaacagccctttgccttccctggagaagtgctgtgttttgggttctaacaacataaatactccccagtcccagtgtttttatggagcccaattcaatgtacgatctccccgtggcatcacctacctataatgattaaggatttgggagattcatttagtgaattttatcaagataacaatcttaacaaacactgtagcatatgcacactccaaaggctttccctctttctacgttaaatccaatggattcctgggactgtgtctcttataggcttttactgggcctaaattttagccaataagcttgtcaaacagctagaaacacattaaactcttcaagcttacctactctatccatgctcttcgggtaagtgtccactttgaaattcaccccaatgcaatcttttatcttggttggatgcacaccttcagaacctattcctaagaaattcttgcatatattgttggcataaatgtcttgcaattctgttgttatatcattttttttctgagtatatttgacccctatttaatgcttagctcttgctcaagttctaggactgcaggcaatgaagactgggtaagtaggggttaggatgagaattatcttctcagtctgaggtaacttcctcatatgtaaaggctactaaggcaggtttggaaatgggtttatatatgcatttccgaatatcctaataatatttggctgcttacattagtaaaaatcattaaagttgctttcactcaaagactgtaagatataaagaaaagttatttaaaatgtaaagcattgaacagaaaacaatcggaaactaatcaatgaaatgggtatatataggaggattccaaaaattcggagactctaaccagtgaatccagccttgctagtacatccctgcagccagatacagttgcacttgctggaccactacaacatcgggtgccaatctaaccactgaatccaacctccttgtacatcactgcaaccagatgcagttgcacttgctggaccactacaacatcgggtgccaatttaatactttcttcttttcactctctaccccrgtttcagtatccttggcagtatgctatgttcaactgactttgagatgtatgattctattttgacaccaacaggcttagaaaagagtaaactgaacactctggcttttgtagggagaagtagaactccgtgtagcacgaagtcttatgcaaaagtaggaagcagtgtaggaggattggcagaccaaaaaatgaaaagtgacaaatatttatatacagccagataattttgttataagtcaatactctagattttttaaatctcccatctccaaggcaatttaggcaacagcaagtatcttataaaattctctttttttagaaaatatagatgaattatttaagatggattatcattatttattgtgtatttagtataggtttatttatctcacacttctttgtctttttccattattttcagctgttcaaaaattctgcatttgtaacaacttcctcaatatgtaaatttaaaaatccctcaatatttgccatcttattctgaagtgtttaccatcttactctaaagtaatctgaacaccacatgcattattgttggagttttaaaacattagtatttatctgatcctaatgttttattgtaattgtatagattttttcactaattttggaagggtaaactattgtttcatagatgcaataaatcctggaaacttgtttgcaatacttttaaaagcagttttcaaaatttctcctctatcacacaggagacacactgtaatgactactatttcctctgatttcttttaggtgcgtttcttttgactgtattttcatcagtctcatcatttttctgtgtcatccatttgcgctgggacttgtgcctactgatggttttcaagtgtggctgcaatttggttcccttgaaggtattttaaaatatgctgatgcactagtaccattcccaaaccaactgaaacacattcttcaatggcaaggtcatggtgctggtatttaaaacaaaaatcttcctaagttattttaatatacaactacaacatattcactggtatagataatattgaatacaaaaaaaacctatatgatgactcgttccttctgtgagagagcaaagtccacaatttaaaaaaattaataatactgttaactcagagggatcagaccaggtggaaagcacgaatatgcactctgcataatgaagcttatttccagtgtacaaatctacagcaagcagaaaaggatacttggtgcagtttgctctagatacacagctaacacagcgagccatgcagtggggcctccacctagaggaactgattacaggaagaggaagttttgatttcaaccttgttaggctttccttccagttagtaatggtttcaagctgaatggatgacacaacatgaaaaattcaactacttaagaatagcatgcgccaagtatattctataactttctgttaagattcatttcacttaataattttctatataaatctctattaatttaagtttctgaataactgtagggtcaacaacatatttggtactctcctactttgagcttggttgaaccacataatttgaaagaggatattttataaagttaaaatcctgataactttaaagactgataaatttctgtttgcattcagaatatagtggcagaaaaaaatattcctttctaaattataatgattaaattgttttgatggtattatgttgctataaataatttcctagagatattaaggtatacttacataagatttattcacatttatgatattttaggctgaccttaaaaattatttatgaatttaattgcttatgcatatgtgataaatgctaattataatatttacttggctttaataaatatttccagttgcaatttgataggctaactgtatgtaaaaatttcataatattgtctagaatagtttttctttattctgatcctttttagttatagtcttatagatatggccttagttcaaaagcactatacactcgtgaaacatttctaagtcaatgtaaaatattgtaatgtgatgtcagaataaaatctttttgaagatagagattttcatggtttttttccaaatcagagtttaaagtagtcaatctcatgatttgtcagacttgaaaagttatagaatgaatattttaacataaaaataacttaaatgaatatccttagaatacaaatcaactgtatattcactcgaggcacttaaaatattctatatgccaaaaactgcatatctctttccaatttttaatactgctttctctctctctctcttagtttacaaatatttctcaatatttaaacttttagaactgaatcatgttggggaaatgaagtctttggggaaataatttattatgaaaaatttttatgtagttattaaaaaaattctaactcagttaaacaatattatatggaaatgccatagtttgaaaaattgtcaaggttaagataaaacaaaaaaatatttttgactttttttttcttttcttttattattatactttaagttttagggtacatgtgcacattgtgcaggttatttacatatgtatacatgggccatgctggtgtcctgcacccattaacttgtcatttagcattaggtatatctcccaatgctatccctcccccctccccccaccccacaacangtccccagagtgtgatgttccccttcctgtgtccacgtgatctcattgttncaattcccacctatgagtgagaatatgcggtgtttggttttttgttcttgtgatagtttactgagaatgatgatttccaatttcatccatgtccctacaaaggacatgaactcatcattttttatggctgcatagtattccatagtgtatatgtgccacattttcttaatccagtctatcattgttggacatttgggttggttccaagtctttgctattgtgaataatgccacaataaacatacgtgtgcatgtgtctttacaacaacatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttcatggggttgtctgtttttttcttgtaaatttgtttgagttcattgtagattctggatattagccctttgtcagatgagtaggttgcgaaaattttctcccattttgtaggttccatgttcactctgatggtagtttcttttgctgtgcagaagctctttaatttagttagatcccatttgtcaattttgtcttttgttgccattgcttttggtatttagacgtgaagtccttgcccatgcctatgtcctgaatggt

SEQ ID NO: 2 - DNA, 2226 bp, Homo sapiens
  5'UTR 1..95
  CDS 96..167
  3'UTR 168..2226
  polyA_signal 2200..2205
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggaaaataacgcatttataaaagccagctcagatgttacttccaaccaacaaatttcctggacacactaagtaatagagttaatcacaccgtcctgaacattcaccctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacctcctgccatgccctttccaaatcctggaccaacagaatcatcatatacactaggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 3 - DNA, 2431 bp, Homo sapiens
  5'UTR 1..95
  CDS 96..167
  3'UTR 168..2431
  polyA_signal 2405..2410
  allele 132: 8-130-143  : polymorphic base A or G
  allele 132: 8-126-286  : polymorphic base A or G
  allele 328: 8-155-258  : polymorphic base C or T
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggaaaataacgcatttataaaagccagctcagatgttacttccaaccaacaaatttcctggacacactaagtaatagagttaatcacaccgtccttgaaggtctccctgctgtgcttagagagggggatgctggaagaagagtggtcagagaagcaacattgctgactcyaaagacagagggcaggccacgagccaaggcatgcaggaggcctccagaagctggggcaggcaagagaatggactcagccctggagcctccagaaggcatgcagccctgcccattccttgcttttagccaggaacattcaccctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacctcctgccatgccctttccaaatcctggaccaacagaatcatcatatacactaggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 4 - DNA, 2215 bp, Homo sapiens
  5'UTR 1..95
  CDS 96..311
  3'UTR 312..2215
  polyA_signal 2189..2194
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggtaacctcatcaccggagtcaagtgtcatcacctttcccatgttccattggttagaagtcccagctcctgcccacattcaagggaacattcaccctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacctcctgccatgccctttccaaatcctggaccaacagaatcatcatatacactaggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 5 - DNA, 2132 bp, Homo sapiens
  5'UTR 1..95
  CDS 96..212
  3'UTR 213..2132
  polyA_signal 2106..2111
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggaacattcaccctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacctcctgccatgccctttccaaatcctggaccaacagaatcatcatatacactaggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 6 - DNA, 1981 bp, Homo sapiens
  5'UTR 1..95
  CDS 96..260
  3'UTR 261..1981
  polyA_signal 1955..1960
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggtaacctcatcaccggagtcaagtgtcatcacctttcccatgttccattggttagaagtcccagctcctgcccacattcaaggggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 7 - DNA, 1992 bp, Homo sapiens
  5'UTR 1..95
  CDS 96..167
  3'UTR 168..1992
  polyA_signal 1966..1971
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggaaaataacgcatttataaaagccagctcagatgttacttccaaccaacaaatttcctggacacactaagtaatagagttaatcacaccgtcctggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 8 - DNA, 1898 bp, Homo sapiens
  5'UTR 1..95
  CDS 96..182
  3'UTR 183..1898
  polyA_signal 1872..1877
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaagggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 9 - DNA, 1783 bp, Homo sapiens
  5'UTR 1..95
  CDS 96..167
  3'UTR 168..1783
  polyA_signal 1757..1762
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggaaaataacgcatttataaaagccagctcagatgttacttccaaccaacaaatttcctggacacactaagtaatagagttaatcacaccgtcctgaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 10 - DNA, 2309 bp, Homo sapiens
  5'UTR 1..95
  CDS 96..311
  3'UTR 312..2309
  polyA_signal 2283..2288
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggtaacctcatcaccggagtcaagtgtcatcacctttcccatgttccattggttagaagtcccagctcctgcccacattcaagggaaaataacgcatttataaaagccagctcagatgttacttccaaccaacaaatttcctggacacactaagtaatagagttaatcacaccgtcctgaacattcaccctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacctcctgccatgccctttccaaatcctggaccaacagaatcatcatatacactaggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 11 - DNA, 2075 bp, Homo sapiens
  5'UTR 1..95
  CDS 96..311
  3'UTR 312..2075
  polyA_signal 2049..2054
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggtaacctcatcaccggagtcaagtgtcatcacctttcccatgttccattggttagaagtcccagctcctgcccacattcaagggaaaataacgcatttataaaagccagctcagatgttacttccaaccaacaaatttcctggacacactaagtaatagagttaatcacaccgtcctggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 12 - DNA, 1923 bp, Homo sapiens
  5'UTR 1..95
  CDS 96..212
  3'UTR 213..1923
  polyA_signal 1897..1902
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggaacattcaccctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacctcctgccatgccctttccaaatcctggaccaacagaatcatcatatacactagaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 13 - DNA, 2308 bp, Homo sapiens
  5'UTR 1..95
  CDS 96..167
  3'UTR 168..2308
  polyA_signal 2282..2287
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggaaaataacgcatttataaaagccagctcagatgttacttccaaccaacaaatttcctggacacactaagtaatagagttaatcacaccgtcctaaacaatacgaacagaaacaaagctatgtacttgttttgggaagcaacctcaaatggaaagatgggggctgtgttctaaaaggaacattcaccctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacctcctgccatgccctttccaaatcctggaccaacagaatcatcatatacactaggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 14 - DNA, 2706 bp, Homo sapiens
  5'UTR 1..95
  CDS 96..167
  3'UTR 168..2706
  polyA_signal 2680..2685
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggaaaataacgcatttataaaagccagctcagatgttacttccaaccaacaaatttcctggacacactaagtaatagagttaatcacaccgtcctgaacattcaccctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacctcctgccatgccctttccaaatcctggaccaacagaatcatcatatacactagtaagcttttactttaagccactaatttggggtgtagctcttttgcagcaaaagatcatcagaacactgccatgcaggagctgataaacttgctcactgttatgtatgtatccaatgactactcacacacacattacttgcttcactctactttctggctttccattcagcaaattttaagaaatgaaaatgttattcgtgggaaattaactcaagatcaatattgttgtagttaatctctttgtaaatggtaaaatattaaattattgtgagtcatttttatttaaagaagtttggttctttaaatgaaagaagtttgggtcttttgtggatactctgcatatagacattctagacatgaaagaatgttgaagacaaagaatgttgaagaaatatagacatgaaagactgttgaagtttggttttttgtggatactctgcatatagacattctagactggagtgatacatcttgttcagggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 15 - DNA, 2612 bp, Homo sapiens
  5'UTR 1..95
  CDS 96..212
  3'UTR 213..2612
  polyA_signal 2586..2591
  allele 132: 8-130-143  : polymorphic base A or G
  allele 132: 8-126-286  : polymorphic base A or G
ttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaaggaacattcaccctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacctcctgccatgccctttccaaatcctggaccaacagaatcatcatatacactagtaagcttttactttaagccactaatttggggtgtagctcttttgcagcaaaagatcatcagaacactgccatgcaggagctgataaacttgctcactgttatgtatgtatccaatgactactcacacacacattacttgcttcactctactttctggctttccattcagcaaattttaagaaatgaaaatgttattcgtgggaaattaactcaagatcaatattgttgtagttaatctctttgtaaatggtaaaatattaaattattgtgagtcatttttatttaaagaagtttggttctttaaatgaaagaagtttgggtcttttgtggatactctgcatatagacattctagacatgaaagaatgttgaagacaaagaatgttgaagaaatatagacatgaaagactgttgaagtttggttttttgtggatactctgcatatagacattctagactggagtgatacatcttgttcagggttttgtgcatctctaagatgatcatcttggtgtggggtcctgatcttcccagtgacttagcagcacagtaatttggctgaaatgttgatgagttcagacaagaagaaggtgatgatgacaagagagcgtcacggggaaattctgccctgaggaaggaatagtttgaggctggagagatgtgctacccccgccactctttctcaaatggaaagacaacctgtaggcacagaaatcattgctctgcttacactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctgcttataattgcagaggaacattttgagatagaaaattttatccctctttcaagtgactttttataaaacataaccttttaagagaggtcattcttttgaaaaattgtctgaatacaaaaaagtaactgaacagcaagggattgtagccataatgttcttgaccactttagattgacaaatagtatctcaaaattgatcaggttctggagaatctattgaggttgtatggagtaaccaagtgatggaagaggttggaagtgaataattttatgtggtattatgtgattttttttggtgggggtagtgtctggagctgagcatgatggagcctagatggggcagccttctaatgctcccagtatttcgcaaatcatatgtcacgtcaaaattgtaatgacaaagctcacagcagctgcctacgccaggtttggtgccagctctaattagagcattgatcatttctctccccttcatgaatgcacatgagtgcacattttcatatataagggcaaaggacatttcaaagtttggatggaatctttcctacttagaagtaataaaaaacaatactttgaaatcttaccaaatgttaaacaaatagcaacaatttttccatttgaagatgtgtgtcttaaggtctgttggatctttcaaatttctattttggacatggaaactacagatgaaatttaacttactcaaagttacacagaactcctggctgatctcttttacttaattcttctaaaatctaaagtaagaataattttgaaattttattggtaatgcttaaataacaaaagttactttaatatgttacatgtttgaagtttcatttatacttaatatctaatttaacgcttgtgaaaatattattcagtatttttttttcttttctaaaatgacttgttcagggctccttttgggattttaagtgagaaaaactctatttcataatattgttaccatgctcatccaataacacttcatagatggttagccatctctaaaattaaattttgtagttgaggagcattgaaaatatcacctatatttggatttctgtttaacacttcaaaatgcattttatcataatttaaaatttgatttaaatacaaacctctttatagaaaacctgataaatgtagttttatttgtttgcttgcttttttttgcagggagggatattcccttgataccactctgtctttatgactcatcggttatttataaatgttatcatcgtttttctgatttttaaataagtttcagaattaatacatttaactgaataaatcaaccaataatgtcaaactt

SEQ ID NO: 16 - DNA, 434 bp, Homo sapiens
  5'UTR 1..370
  CDS 371..436
  3'UTR 437..434
  allele 407: 8-130-143  : polymorphic base A or G
  allele 407: 8-126-286  : polymorphic base A or G
tcccagtgggattcaaccactcatagactgcttttgttcaaactgcgttcaaataaggcaaacgccgagctggaaccaatctcactgtttctgtacctcgcttctaattccttttcagaaaacaaaaactcctaagagaatgaatagaaattttcttaaggaattataaagaaccatctcagaattttactctgttactgcaaaatctcatgcaaagataaccaagtacgaagaattaactgaaattcatcccaagatgaggcatcttggctgagttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaag

SEQ ID NO: 17 - DNA, 760 bp, Homo sapiens
  5'UTR 1..696
  CDS 697..762
  3'UTR 763..760
  allele 733: 8-130-143  : polymorphic base A or G
  allele 733: 8-126-286  : polymorphic base A or G
tcccagtgggattcaaccactcatagactgcttttgttcaaactgcgttcaaataaggcaaacgccgagctggaaccaatctcactgtttctgtacctcgcttctaattcctgtacgtcactttaccttttttgtctataaatttattctgaccacaaggcacccctggagcctctgtgagtctgctgtggttctggggactgccggattcgcgaatcgttcatttctcagttaaactcctttaaattaattcagctgaagtttttcttttatcaatgaaaagactagactggcttagccttccagcctgcacctttctcccatgctggatgcttcctgcccttgaatatcagactccaagttcttcagttttgggactcagactggcttccttgctcctcagcttgcagatgccctattgtggggtcttgtgttcgttttcagaaaacaaaaactcctaagagaatgaatagaaattttcttaaggaattataaagaaccatctcagaattttactctgttactgcaaaatctcatgcaaagataaccaagtacgaagaattaactgaaattcatcccaagatgaggcatcttggctgagttgcaggtccacattcgttctagaggctgcctgcggtccttagaggcctcataggcaaggaactcatagtttcttgccatgaagacttttccaacatggctgcttacttcttcaagcctgtaaggagatccrgtctcagttggccaggtcttgtgaaag

SEQ ID NO: 18 - protein, 23 aa, Homo sapiens
  VARIANT 13: Xaa=Gly or Ser
MAAYFFKPVRRSXLSWPGLVKGK

SEQ ID NO: 19 - protein, 71 aa, Homo sapiens
  VARIANT 13: Xaa=Gly or Ser
MAAYFFKPVRRSXLSWPGLVKGNLITGVKCHHLSHVPLVRSPSSCPHSREHSPWELCAAMQMSHCTEAAML

SEQ ID NO: 20 - protein, 38 aa, Homo sapiens
  VARIANT 13: Xaa=Gly or Ser
MAAYFFKPVRRSXLSWPGLVKGTFTLGALCCHANVTLH

SEQ ID NO: 21 - protein, 54 aa, Homo sapiens
  VARIANT 13: Xaa=Gly or Ser
MAAYFFKPVRRSXLSWPGLVKGNLITGVKCHHLSHVPLVRSPSSCPHSRGFVHL

SEQ ID NO: 22 - protein, 28 aa, Homo sapiens
  VARIANT 13: Xaa=Gly or Ser
MAAYFFKPVRRSXLSWPGLVKGFCASLR

SEQ ID NO: 23 - protein, 71 aa, Homo sapiens
  VARIANT 13: Xaa=Gly or Ser
MAAYFFKPVRRSXLSWPGLVKGNLITGVKCHHLSHVPLVRSPSSCPHSRENNAFIKASSDVTSNQQISWTH

SEQ ID NO: 24 - DNA, 427 bp, Homo sapiens
  allele 231: 8-102-231 : polymorphic base C or T
  misc_binding 219..243: 8-102-231.probe
  primer_bind 212..230: 8-102-231.mis
  primer_bind 232..250: 8-102-231.mis complement
  primer_bind 1..20: 8-102.pu
  primer_bind 408..427: 8-102.rp complement
cccacagaaatatctaattgaaatattaaattgatttggattatctactctcttgagagagatggtataaaaattcattaattataattttatgtgcatgtaacaaacagtcttttttgttttcatggtttaggtacatgtcactgtggcaggtgtaagtgtgataattcagatggaagtggacttgtgtatggtaaattttgtgagtgtgacgatagagaatgcatagaygatgaaacagaagaaatatgtggaggtatgtatattggctctgtagaaattaataaaagtacctgtttttttcacctatttcattgttcttttatctctacataagtttctgctctaggtgtgctaatgtagtttaaacctatgtttatctggaaaacatttcacataaggagagtgagactatggcattaagagt

SEQ ID NO: 25 - DNA, 310 bp, Homo sapiens
  allele 105: 8-104-105 : polymorphic base A or G
  misc_binding 93..117: 8-104-105.probe
  primer_bind 86..104: 8-104-105.mis
  primer_bind 106..124: 8-104-105.mis complement
  primer_bind 1..21: 8-104.pu
  primer_bind 295..310: 8-104.rp complement
gatggtgtttttcctttttagaatatttttgtctgaatatatgtgtttttttcaaacacaaagtaaacagaaaataataagcgatatgtgaaatgctttctttcrtggtttttcttgactggattcttataaaattcttcttcccacctagggacttgtgtatgtggtgaatgtacctgtcacgatgttgatccgactggggactggggagatattcatggggacacctgtgaatgtgatgagagggactgtagagctgtctatgaccgatattctgatgacttctgttcaggwaagggctcttccaatt

SEQ ID NO: 26 - DNA, 418 bp, Homo sapiens
  allele 251: 8-94-252 : polymorphic base A or G
  misc_binding 239..263: 8-94-252.probe
  primer_bind 232..250: 8-94-252.mis
  primer_bind 252..270: 8-94-252.mis complement
  primer_bind 1..18: 8-94.pu
  primer_bind 400..418: 8-94.rp complement
gtggtctatgcaggtatggatggacattctcacacctaaccaagcaatgtttgcttttcctcctcctttcttcccatcactagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatagccagatcctcacaggtgttgtgacttattcrtcctgagcacagttgagtgatttatcctcaccagacattcctgctccgtggctgaagagcagcaggaagtaagctaatgcttattctttgctgtctccgaacttctctgttgcaagtggataaatctcaacctttgcaccccccacaacaagaagacacctggataa

SEQ ID NO: 27 - DNA, 419 bp, Homo sapiens
  allele 43: 8-95-43 : polymorphic base A or G
  misc_binding 31..55: 8-95-43.probe
  primer_bind 24..42: 8-95-43.mis
  primer_bind 44..62: 8-95-43.mis complement
  primer_bind 1..18: 8-95.pu
  primer_bind 400..419: 8-95.rp complement
gactggaactattctaggagatttgggtttaatagtgtgctcrcctccttgaaagccttagtgattccgggactctcctcataagtgtgcactttctttatactttccaggtaaatgtgaatgtggcaaatgcacctgctatcctccaggagatcgccgggtgtatggcaagacttgtgagtgtgatgatcgccgctgtgaagacctcgatggtgtggtctgtggaggtagtaacctttctcatagctgtatgctacctgcatgcaacttgctttacctgcctttgttattctactgactcttgctttttcaattgctgttaaaaataagataaacagaaagcaatataccattgaacctaaaagcaatatacaattaggtttgtaatgacttttatttccctgactcctttatttagc

SEQ ID NO: 28 - DNA, 350 bp, Homo sapiens
  allele 181: 8-97-181 : polymorphic base A or G
  misc_binding 169..193: 8-97-181.probe
  primer_bind 162..180: 8-97-181.mis
  primer_bind 182..200: 8-97-181.mis complement
  primer_bind 1..18: 8-97.pu
  primer_bind 331..350: 8-97.rp complement
  allele 98: 8-97-98 : polymorphic base C or T
  misc_binding 86..110: 8-97-98.probe
  primer_bind 79..97: 8-97-98.mis
  primer_bind 99..117: 8-97-98.mis complement
ctgagaaaccagccattcaatacacttttacctttggatgatgggttattagaagcctgttgtcagtgtgtcaacgatattctattcgagatggaaayctttagttataaggtgatggtgagtaatagcctttgtaatttcaggttcttgtcattgtgggaagtgcatttgttctgctgargagtggtatatttctggggagttctgtgactgtgatgacagagactgcgacaaacatgatggtctcatttgtacaggtgcagtattaaccttttctaattgctctatgccacagtttgttatagagccaagagacactcgtcatgcaatgctttagtgggctggaccaa

SEQ ID NO: 29 - DNA, 434 bp, Homo sapiens
  allele 68: 8-98-68 : polymorphic base A or G
  misc_binding 56..80: 8-98-68.probe
  primer_bind 49..67: 8-98-68.mis
  primer_bind 69..87: 8-98-68.mis complement
  primer_bind 1..19: 8-98.pu
  primer_bind 415..434: 8-98.rp complement
  misc_feature 414,416: n=a, g, c or t
atttcattgtggacacttgtgatttataatagcatgtttaaatttggcacattttgatcataatcatratacctatatgtattttattgcagggaatggaatatgtagctgtggaaactgtgaatgctgggatggatggaatggaaatgcatgtgaaatctggcttggctcagaatatccttaacaattacatgagagaggtctggattcttattttttctgggccattagaacatataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggtncntaacgagagcaatttttc

SEQ ID NO: 30 - DNA, 477 bp, Homo sapiens
  allele 108: 99-14021-108 : polymorphic base A or G
  misc_binding 96..120: 99-14021-108.probe
  primer_bind 89..107: 99-14021-108.mis
  primer_bind 109..127: 99-14021-108.mis complement
  primer_bind 1..18: 99-14021.pu
  primer_bind 465..477: 99-14021.rp complement
tttgttgttaatcgccccttttctgcaacacttgtgggttagggaaaataattctaaagcaagagcaaagacagagttgggagatcaccagtgaggttcaattttccrtcacattcactctgctccacacctcagataatcatgtgcttaactgcgaaacttgcttgacaattacagaacactttctcacccattactaccttgatcctcacaattctgtggggtagtaggagcagatgctgaaattgccatacgcaaatcagtgaactgaagcttagagacctccagcaggggcagagggtcagcggaaactatcccagggttcagccaacaagaaagtatattggaatcagagtattaaaataagaataataaaaccaactaaaatttaccgtgctttttatttccactcagtgccaacaattcttaacagtgtcagtgatggatccctgtgccccagggrmcagacttcttact

SEQ ID NO: 31 - DNA, 473 bp, Homo sapiens
  allele 415: 99-14364-415 : polymorphic base C or T
  misc_binding 403..427: 99-14364-415.probe
  primer_bind 396..414: 99-14364-415.mis
  primer_bind 416..434: 99-14364-415.mis complement
  primer_bind 64..82: 99-14364.pu
  primer_bind 434..454: 99-14364.rp complement
catgcccatcctaaatatttacatgccctgacagataagcccttagcctgcccaatgggtaacttcaacagcatctctagtacaactgttgctcattctgtgttttaattcaacccagctataagatacgaaatgatagaattgctctagattctctattggttaaataaggagatatttgtgctattgccaataatacatgctgtacctggataaacccctttgggcaagttgtgatgcaaatactcaagaaaataggccacatagttacaacaggacttacctaattccccatggtcatttggctgattcagtcagttgctttcaagcctaggttcttggctcaatattattacataaactagaattttcctattactattaattttactttgtatttttctttataaacttygtacttattgcttgtcaaatttcagcagaagtacaactcctgagagaataatgctggc

SEQ ID NO: 32 - DNA, 502 bp, Homo sapiens
  allele 99: 99-15056-99 : polymorphic base C or T
  misc_binding 87..111: 99-15056-99.probe
  primer_bind 80..98: 99-15056-99.mis
  primer_bind 100..118: 99-15056-99.mis complement
  primer_bind 1..18: 99-15056.pu
  primer_bind 482..502: 99-15056.rp complement
caggaaactcacaagaagscagatttccttcgagcacctcctgaataaagaggcaaaggccttcttaactcttacaatttacaagtggctatgagtgcytttatagttcccataataatttctccacgtagacttcctaaataataatttctcctgttttatattctctgtgcttatgtttatatcaaacaagttaccacttaatcaaatgccgatttgcattgctcactatgtaactttaattttctttgcctcttatttttggatcttaattctaaaactagatgatcataaattcatttaggaataagcttgtgatctagccttcttttgaacccctttgtgctcctcacaatatttgtttcgatgaaacagtgagcaacatttgatctatgattgttaatagaaaaacaccaatgtctcaagttattgtaaacataggcataattgacctttggttctataaatatgtttggtgttccccaaaatacgtctccctttt

SEQ ID NO: 33 - DNA, 494 bp, Homo sapiens
  allele 412: 99-15229-412 : polymorphic base A or G
  misc_binding 400..424: 99-15229-412.probe
  primer_bind 393..411: 99-15229-412.mis
  primer_bind 413..431: 99-15229-412.mis complement
  primer_bind 1..20: 99-15229.pu
  primer_bind 476..494: 99-15229.rp complement
ctgtcattgagaaatgctaccaataatacttagagaatttgatacaactcagtctgaaaaagctaagattagcagaacagagctgtctccaaatatttgaagaactattttatttaagggattggacccatttttgtatgtagttccagaggagcagatggtgaccactgtccaggcagatgtgtctcaatgtaaggacaacatctgtaatattaataattagaatgtatcctgtaattttctctctacccttggaaaccagtcgagatccagagtctttcactgggaggcttaaagcctagagcagccttggtgctagaggcggacagggataatgaactaatcttgaaccaattcatccatagcaatctcaatgctttcgttagctcttataggtatttaatacggccaraggaatgaaggtagtcttgctggtttagaagccctgcctaccacaacccctacaccaccccatcccctgcatagtctgatgt

SEQ ID NO: 34 - DNA, 485 bp, Homo sapiens
  allele 291: 99-15232-291 : polymorphic base G or T
  misc_binding 279..303: 99-15232-291.probe
  primer_bind 272..290: 99-15232-291.mis
  primer_bind 292..310: 99-15232-291.mis complement
  primer_bind 1..18: 99-15232.pu
  primer_bind 467..485: 99-15232.rp complement
caatagaacaggctgctcctttataattattaatcatagtgtatattaattcatcatcacatacgtggctagaaaaaaatttagaacaaaaagatatgtgatatgtaaaggcctacgataattcagacttctttgaggagagcttttattttattgttattcttattttatctcttgtcaatataaattgagagaataaacagacaaacattacaaattagtgattaattgcatttaaagcctagttaagactatttaagactattatgcataatacaggaaaactacctktattatttatagtgggtgccttctgaaggatctgaaggagaatcagttctatgcctctctcctcattcccaggaggtgcctggcattccttggcttgtagacgcatcaccctaatctctacctctgccttcacatggtgtcccctgtgtgtgtgtttttgccccatgtgtctcctctttttatatggatgccag

SEQ ID NO: 35 - DNA, 477 bp, Homo sapiens
  allele 382: 99-15253-382 : polymorphic base C or T
  misc_binding 370..394: 99-15253-382.probe
  primer_bind 363..381: 99-15253-382.mis
  primer_bind 383..401: 99-15253-382.mis complement
  primer_bind 1..19: 99-15253.pu
  primer_bind 459..477: 99-15253.rp complement
aaaatcaattccccaacactcattttgtacgctaattttgtaagatcctgaaaagtttcactattttatggtttcatgtgttacagatgaaaaaaaaactagaattcaaattttctgagtttttttttacaatattttatgattacaaagttagaagactaagaataaaatggcctaatttccataatgtgagtggtaaatgcagagcactggcctaaagaaaatatttcaaaaaattagtcatcttttccttaatttttttccaacctatgatctgttgaatgagcattttgcatatataaataaataaattactttgtaaataatcttgactggtttctgttgaccacagtaacccactgcacagcacagcctgtaattyctatgaacctagggaaatgtatttaagtttattttttgattacacaggtcctcattgtgtaactaaacattgcatagaatatgccagtgatgatg

SEQ ID NO: 36 - DNA, 456 bp, Homo sapiens
  allele 392: 99-15256-392 : polymorphic base C or T
  misc_binding 380..404: 99-15256-392.probe
  primer_bind 373..391: 99-15256-392.mis
  primer_bind 393..411: 99-15256-392.mis complement
  primer_bind 1..18: 99-15256.pu
  primer_bind 439..456: 99-15256.rp complement
cctctctatgatgcttcctattaagcaattggggaaatgtaataaacaagggttggtgagcatcttccttagtgagatgtttttggaagaattggataattgagtgaataatagtgagaaactcctgtgtctgatgttgctccatgttggaatgcttttatgttctcagagaatgagtcactgagagccaattgtgatgatacacaatggttttacccaggttggatatggtcctctgtactggtaccctttaagtcagtggcactaatcagtcagtcattgtcatgctttgtgttggtccatcatatggtatgccctcttagagaacatcctgattagtccttagacatcttttcaatttgaacactggggctcctcattcgggtaaaaaytatggacagtcagtgaaactgttgcaatggcccctcatagcagattggatctcaatgcactttg

SEQ ID NO: 37 - DNA, 541 bp, Homo sapiens
  allele 337: 99-15258-337 : polymorphic base G or T
  misc_binding 325..349: 99-15258-337.probe
  primer_bind 318..336: 99-15258-337.mis
  primer_bind 338..356: 99-15258-337.mis complement
  primer_bind 1..19: 99-15258.pu
  primer_bind 521..541: 99-15258.rp complement
cagtaaagaaggacttaggaaatattttttgaatcatgagctgctaatagatcagtaaataggatttattaaacacagctgtattcaggactctgacctgtgtgggccttagggaaatacaaaatttacaaactgatgtgattttcttaccagtaagaaatcttatgaaagattaaattaaaaaaatataaatgggggcaactcaatcacataaaagtaatatattccatgtgactgaaatactagggaaaatttagaagtagaatttaagtgagaatttcaagcagggttctgaaagattctacaggatgaaggaagaattgcccatatgccaatkgcctatgtgaaatcacaaaaacagaaatcaataaggcatgtatggaagtacagagtgattgcctagttagaaaaagagcgtgaagggatcagttaacacaaacaagaagagtttaatgcttatctgcaataagttggtagagcaaaattaagcacttcccagtatactgatagacgttaattyccactctaccatgtgaaattt

SEQ ID NO: 38 - DNA, 500 bp, Homo sapiens
  allele 200: 99-15261-202 : polymorphic base A or G
  misc_binding 188..212: 99-15261-202.probe
  primer_bind 181..199: 99-15261-202.mis
  primer_bind 201..219: 99-15261-202.mis complement
  primer_bind 1..19: 99-15261.pu
  primer_bind 481..501: 99-15261.rp complement
cttctaatcctttgtttccacttattttatttcattcctcattttatcccttttttctaaattccattttattatacttaaggtgcttttaatatggttatcatactcctgatagtgttatttctttcttagtcttcttatataagcgctatacgttcacattccatctcctttggttatctttccatttcttcaccgarcctctttgctctctttttttatagctggttcactcaaaatgtcttactttgccatttttgaaatttattttcattcttttatgtactgaataaaatttaaaaatactttatcatggtgggaggtacccgtgatgtccaaataagtgtttatattaattgttggggtttttttgtttgtgtgttttttgaaaggttaagaaaatctcattcagaaagtaagttgtttaaaaattctggaccaaatttaccacacatcaagcagatacttaccaagttgtttgtagacattagcagtattta

SEQ ID NO: 39 - DNA, 541 bp, Homo sapiens
  allele 432: 99-15280-432 : polymorphic base C or T
  misc_binding 420..444: 99-15280-432.probe
  primer_bind 413..431: 99-15280-432.mis
  primer_bind 433..451: 99-15280-432.mis complement
  primer_bind 1..18: 99-15280.pu
  primer_bind 521..541: 99-15280.rp complement
atgtccatccatcttgcccagagagagtttctacaacacttcctctgcaagccctttccctacttgcctcacctattgctttcctctgttacgttgtattcccctcactgtttcttccaacatcttcccacctcagagcatggacacttgctgctctttctgtgtcatgatgctgctcacttgtccctttcttaatgtctcctccctgagccaatcttctccacccccacaacttacgcacacttacatgtcatattttccttcatagcctttaacaccatttgaaatgatatatatttgattgcttttaaaatttctctgtccccccactaaatataaacttcaggatggcaagaatgtagtccattatcttatttctccagcctccatacttttaagaaaataaattttggttgtataagccatccagtyagtggtacttggttatagcacccctagcaaaagaatacaaaaaaagggagaatgtttgcaatcatctgtttgaggctaggaattcccagagaggraamcaaggagtaat

SEQ ID NO: 40 - DNA, 489 bp, Homo sapiens
  allele 150: 99-15355-150 : polymorphic base C or T
  misc_binding 138..162: 99-15355-150.probe
  primer_bind 131..149: 99-15355-150.mis
  primer_bind 151..169: 99-15355-150.mis complement
  primer_bind 1..18: 99-15355.pu
  primer_bind 471..489: 99-15355.rp complement
taacttctccgtctctccttcttagcccatatgtcaataatgactgaaagtattcatttccatctttaaactgcctattccagccacctcccacctccatctctttccttctaagttttcttcatcttctactttgggcaaaaggaaatygatgtgtcagacaggcctagttttgaattctggatctgctagcacttctctgtgtgtccttggttatatgatatagtcttaaaccttaatgttcttgcctgtaaaatggggataataaaaacctcttaacagtggttgtttcatgcagctttcattacaaacttcctcattcaaaatcttcaatgatttccatttttcacaaaatgaaattcaaaatttctgtagattattgagacaagtcccctactcttcacctaaatttatcttttatttattctctcatcattatcaacaactactaggctttgttgccttgactccagaggcaaaaatcttatc

SEQ ID NO: 41 - DNA, 450 bp, Homo sapiens
  allele 298: 99-15663-298 : polymorphic base C or T
  misc_binding 286..310: 99-15663-298.probe
  primer_bind 279..297: 99-15663-298.mis
  primer_bind 299..317: 99-15663-298.mis complement
  primer_bind 1..18: 99-15663.pu
  primer_bind 430..450: 99-15663.rp complement
tcccaccttcttctaaacgtgttgcttcaatacgttgataggtgaggacacttaaaaattagactttatagaaataggtttttttttgtttacatatatagttcttttggtatcatatatttagcctctttctaaaatttattttttgatactgaagggagaaatagggagttattaatcaacaggcattaattttagtcaagcaaaataaataagctgtagcgatctgctctgtaacattgtacctacagccaacaattatatgttgtccacttaaaaatgtgttagatctcatagyaactcttcttaccacaataaagtaaaaattctgaaacaataagtgaatacctaaataatacaaacaaatacaatattgtagttttgggcacttaataaatgacagcctcatttctcaattagagatcatcacaagttagacagatgacgatg

SEQ ID NO: 42 - DNA, 502 bp, Homo sapiens
  allele 185: 99-15664-185 : polymorphic base G or T
  misc_binding 173..197: 99-15664-185.probe
  primer_bind 166..184: 99-15664-185.mis
  primer_bind 186..204: 99-15664-185.mis complement
  primer_bind 1..19: 99-15664.pu
  primer_bind 483..502: 99-15664.rp complement
  misc_feature 54: n=a, g, c or t
gtttaccattagcactgtcatatttgtgtgacttgtcattctctacagcggagnacgggctggcacggggcctgatgctgacttgcacaagggaagcctcctgtctctgacttccccaggataattcctggggaaagtgtgctccctagtgttaagagcggtttaatggctggagggtttcagckggctgaccaggcagagaaggagggtgaatcacctctcagcactctccacttagactttgtgtggtcgtcgggtggtcaaaccttctaactagttgtattgcagatttggcattccagtgcaaacaaaagacagaaacacaatgttcacatgctttccagagatcacctggatatcagatcatttgattttcaagtaagtcgaaaccttggtggaaatcattaactatcctgtttatgaccaaaaaataaaatcccaaatttcttctcttcatttcttacctgctttaaaattgtatccaaagcgtgaaagtaaaaga

SEQ ID NO: 43 - DNA, 476 bp, Homo sapiens
  allele 398: 99-15665-398 : polymorphic base A or G
  misc_binding 386..410: 99-15665-398.probe
  primer_bind 379..397: 99-15665-398.mis
  primer_bind 399..417: 99-15665-398.mis complement
  primer_bind 1..20: 99-15665.pu
  primer_bind 458..476: 99-15665.rp complement
cgtaaatgtgaaaagcatagcctcttcttggaatgttaagtataaatatctgaaatactgggcttgatatgtcaacaggagattgatggataaaaatagaattttatataaaaaacaactggacatattagattgttaacttggaagaaagaccatattcaaagaagaaaacatagtgactaatttcaaacatttaaagtcttccctgtggaaacaaaggaatatctttgttctaacacttcaaagaacagggttaaaaaatagactcaccacagagtaaatgcacaattgacaatcgtgaatgaattaaaaaccaaacaaaatattttgtcagctttctatctatgaaactaagaaacaggcttcctactaaggtaatgaatgtaattcacagagarcattcacgtataagtttcattcatgtttcaaatttcattgatttgatcaatgggttattctaataccctcccttattt

SEQ ID NO: 44 - DNA, 459 bp, Homo sapiens
  allele 139: 99-15668-139 : polymorphic base C or T
  misc_binding 127..151: 99-15668-139.probe
  primer_bind 120..138: 99-15668-139.mis
  primer_bind 140..158: 99-15668-139.mis complement
  primer_bind 1..18: 99-15668.pu
  primer_bind 439..459: 99-15668.rp complement
agaggtgagagaaaggtgaattgtgcaaatatggacatcgaagttattcagacacatatggtttccatgtcgtgagaccttaaagcactctcagaaactccaagaaagctgttgattggtcagatttctcacttttgtyccctcaaaacaagattgtcctgaacttataggaaatatactcaaaagtagtatgatttaaggaagtcttccaaatacctgcctcgtttacagataatcaatggaattccaaaagattttatgtgttttaagccctaaaaatgcaaatatccaggaaagggctagcactaaacagagctggcatgtatgcctcagtgcaggtgtatatctcagtgtctcctgaagccagggccttagaggattgtggaaataggtacactgacagcagggactggaagccacagtctggagagcaaagagcagaatccatacttacacctc

SEQ ID NO: 45 - DNA, 547 bp, Homo sapiens
  allele 166: 99-15672-166 : polymorphic base C or T
  misc_binding 154..178: 99-15672-166.probe
  primer_bind 147..165: 99-15672-166.mis
  primer_bind 167..185: 99-15672-166.mis complement
  primer_bind 1..18: 99-15672.pu
  primer_bind 533..547: 99-15672.rp complement
ccaataccataactcctctataggacatggaagagtattatatatgacaaatgattgctatgattattattatcagtgttattattatcctaatcctaagtaatccaataaaagaaaaatacatctgtgcctgtgcgtatgtgcacgtgtgtgcagtcaaatacaygttgagtaaaggtaaagtctagctgtatttaatcaacctacctgaatcctcaggaaaaaattctaaacctagtttaaaacatgtaaactctaagctctctccttatagtcagttagtagcagcacatcttaaaatctggtgtgaatattctcttagttctacatgagtctaactaaacagaggattattcttaggtgtttgaaagagacatatgtgacactgctgttttgagaacaatttaagtgttgtcttgtcatgtacagaagttctcatattactttacataaatggttgcataattgttttatagtaaataatagactgtcaatatttctaggataactccaaaacaaaatttcctagammacattttgaaaaggg

SEQ ID NO: 46 - DNA, 500 bp, Homo sapiens
  allele 318: 99-15682-318 : polymorphic base A or T
  misc_binding 306..330: 99-15682-318.probe
  primer_bind 299..317: 99-15682-318.mis
  primer_bind 319..337: 99-15682-318.mis complement
  primer_bind 1..19: 99-15682.pu
  primer_bind 482..500: 99-15682.rp complement
gtttgatgagcaacaagtggccacacaagtattggagaaaaaaaaaattagaatgtggggagagaggcagtagacacaataaaaaattctatataacaaatgctatatctttaagaaatcgaatctttccattaaatatttgtttaaagttacagactacttagatgttaaagtatcacttatcacaaagatcagtaacttatttcctctgtatagtagatgcctcttctgtagaattaacatttcactataatctctaagatacagttcaagggcacaattttataattcaaagatatttacggcatgaaattgagwtctaaaactcttgtatctttaacaaccattttgtaattaaataactgttgacatttacaatcattgaagaactatttgaactctgtagagtatagatattgaagtacaaaattaattatgagataatatatggagcctgkcggctttattttttaataagtwtgtatgtatgccaataaagg

SEQ ID NO: 47 - DNA, 461 bp, Homo sapiens
  allele 217: 99-16081-217 : polymorphic base C or T
  misc_binding 205..229: 99-16081-217.probe
  primer_bind 198..216: 99-16081-217.mis
  primer_bind 218..236: 99-16081-217.mis complement
  primer_bind 1..18: 99-16081.pu
  primer_bind 443..462: 99-16081.rp complement
caaaggacagagaaccagcaggcaggccctgggtcaagccccgtgatgtcccaggaggaggggaggagggcggagtcggaagggagcgagggagccagggaggcagggccctctgagggcagggagttctccatgaagttccagaagccaatgaccagatcggcgcatgcaaacagcttaaaagaaaacattaggcactggtggcttcgctctaaaygaacagttcttaaaactgctttcagttctagccataataaaggcatttgaattatgttgcttttgatgaaactataaagatattggcttttatacagtatcatgccagaaacaaatttataacattgttatggtataacagcaggaatacttggaatacacatttttcagctgagctctaagaattacttttcccttgccccaggttggcaattaagaactataacttactccaccccactcca

SEQ ID NO: 48 - DNA, 532 bp, Homo sapiens
  allele 218: 99-16082-218 : polymorphic base A or G
  misc_binding 206..230: 99-16082-218.probe
  primer_bind 199..217: 99-16082-218.mis
  primer_bind 219..237: 99-16082-218.mis complement
  primer_bind 1..18: 99-16082.pu
  primer_bind 512..532: 99-16082.rp complement
caattcagcaagagccactttggttaacaaaccttctgggaatgaaggtgctttacaaagaagcaggctgtgataaaaacaaacaagacaacattcataaactgtgggaagcattgttgtcattgggtcacacctcctgcaccaggcaggtggttgtctgctgcgttcctttacagaacagatgctgagcctgcctggaggtggcaatttaccaatcratggtcttaagcaattccaaaggctggggtaaggggtagaaaagagaagctcaaaaatgttagggatggagaaggggggagtgattcaggaagaggagaaacctgttcatttcctcccaaattacaaccactgtcacatccatggctagtcctgtgcaaacttccagtccccagctgatatccctgcagacaagtagagagaggctagaacaaaagctaaagtgtagatgtcccatacactaatcagtgttgttttttaatcagaggttgaaattcatactctgatgcaaactgtattagtcagwtgttgctgc

SEQ ID NO: 49 - DNA, 451 bp, Homo sapiens
  allele 81: 99-20933-81 : polymorphic base A or C
  misc_binding 69..93: 99-20933-81.probe
  primer_bind 62..80: 99-20933-81.mis
  primer_bind 82..100: 99-20933-81.mis complement
  primer_bind 1..19: 99-20933.pu
  primer_bind 432..451: 99-20933.rp complement
ttccattcacatgagaaactatgtgtttactatttctgttatgttttgtatgattttgtgtgcttgtatattttcagtaamtgctggggtagcaagtgtcagaatcactccaaaaaaactgagatatatttgccaagtcaacagtctccagactattgtttcagcaagacaaggggcaaggctctttctgggcctgagtaatcagtaaatatataaaaagaataagaataatagtgaagttactgctagacgtatttccttacatctgaacattttctttcatttgcaacacttaacctggaatcgggtgcttccagaaaatcctgtaaaaatcatgtagcttccaagatttaaagctggcctagawaacatgaacatgatcccatgtcttatctttactcatacatcaggaattctctaaatttctgggagaacattttgtagaagacac

SEQ ID NO: 50 - DNA, 511 bp, Homo sapiens
  allele 71: 99-20977-72 : polymorphic base A or C
  misc_binding 59..83: 99-20977-72.probe
  primer_bind 52..70: 99-20977-72.mis
  primer_bind 72..90: 99-20977-72.mis complement
  primer_bind 1..18: 99-20977.pu
  primer_bind 491..511: 99-20977.rp complement
gtacatggtaggtggtagatggtgaaataatttttatatgtaaggagtttcaaagatgatctaaaacatgmaggcctaaaacaatagatgaaacactatttcaaaatgtattctctctttgttttcactctccatgttacaaaaatggcaacaaattacgtaaatgccaaggaagccaatatatcatatggtaaatgacaaatcaactgtaacattgaaacaacaattaatagctattatagctattaaaatttgaagcaaaattgtgcatctttaaaaattatacacacatgtgagaggactcatgactgaaatctcaatataccatctatccaagttgagttattttcctttttttttttttttaagataattattcttcttcctacttctgggagggacagtgtatgggaggtacctgtcaggcactgtgagaaccctgggctctgaacagatatggggtatttctctcagtatcctcaatgcagctccaataactaatcccatttct

SEQ ID NO: 51 - DNA, 466 bp, Homo sapiens
  allele 89: 99-20978-89 : polymorphic base G or C
  misc_binding 77..101: 99-20978-89.probe
  primer_bind 70..88: 99-20978-89.mis
  primer_bind 90..108: 99-20978-89.mis complement
  primer_bind 1..19: 99-20978.pu
  primer_bind 446..466: 99-20978.rp complement
acttaactgctacctaatgcagcctgtacaagcggaataattgaactaaaatgtcttcaacactaaaaataaaatgcaaatcaaatctstttaaaaaaccaaaaccaacttgtattttgaagattaactgccactgtgtctaaacccaaatcctgctagccagagctgaatttgtgattacaaagcagtaacgcaaaggttagaaaggatcaaagatcttgaaaaacctcttctcagatccatctcacttttccattggccacatttccaatacatctctgccccattaaaaccttaccaaaattgctagttcagtactataagtttaaaacaaatgggttgctcaattccttttgatgcatcttccgcatctctcgctctttttctttttttctattttcactgccagcccctcattacctctcttaggtggtcttcccacctgcagttttccttttcaaatcct

SEQ ID NO: 52 - DNA, 449 bp, Homo sapiens
  allele 300: 99-20981-300 : polymorphic base A or G
  misc_binding 288..312: 99-20981-300.probe
  primer_bind 281..299: 99-20981-300.mis
  primer_bind 301..319: 99-20981-300.mis complement
  primer_bind 1..18: 99-20981.pu
  primer_bind 429..449: 99-20981.rp complement
tttgccatccctttgctgatggtttgatttggaatgtgtcatttcgtttgtgaaatgagacatagtcaaggtacccatgtgctcaagtgcttagattacaacaatgttttgatgcaaatgtgcaaagtactcagagatcaacactatggtctaataacaggccatagcaaaatagagcaaatgaatcctgtgaaatcagagagaatgcatcaaataaagatgtactacctaaagtgcaaaatctactaggagcactttgacatttcagttcaagttctacagtgtttcacattttttcartctctattgtagtctcacttggaggtgattgcttgatcactagaggaatatgatattattcgtttcagaaatgaagcagctatggtgttctcttgtgaatagcactagatatgaattaggattatgatcttgtttgtgtagaatgtttc

SEQ ID NO: 53 - DNA, 449 bp, Homo sapiens
  allele 48: 99-20983-48 : polymorphic base A or G
  misc_binding 36..60: 99-20983-48.probe
  primer_bind 29..47: 99-20983-48.mis
  primer_bind 49..67: 99-20983-48.mis complement
  primer_bind 1..19: 99-20983.pu
  primer_bind 431..449: 99-20983.rp complement
catgacacatcaataagagaagcctgctggcacagaggagggcaggtraaaccacctttgtagaagaggctcatttgaaaatgctcctgaaagatatgatatcagaacactatcttatgtagagtggataagactttgatgatcttgaaaatgcttactgaggaatacatagcatttatctttctttccttgattaaagaactttcatatatacatatttatcctgtatggataggtaggagaggtgatgccagcccacagagatgaccagtccctattccagaagttctgagttgttgcttaagtgaagaagtatgctggtctgctttcaaacttctgtaaacttcagcttagtggtagaacagttagaaaatccaaatatttagtttcaatgcctgagtagtccatttactgattttcaccaactctgtaccatcaccttggtctaa

SEQ ID NO: 54 - DNA, 466 bp, Homo sapiens
  allele 148: 99-22310-148 : polymorphic base C or T
  misc_binding 136..160: 99-22310-148.probe
  primer_bind 129..147: 99-22310-148.mis
  primer_bind 149..167: 99-22310-148.mis complement
  primer_bind 1..19: 99-22310.pu
  primer_bind 446..466: 99-22310.rp complement
gtgtgatacgagatcattctttttttaaaagctccctagggtttcagaagtgcagcacaggttgaaagctaccgatatagagcaaagctttactaaaagctgatatgtggaagcaaagaatgtgaaatgactcctgaaggcaccaaaytgacaatgcaaatcaaatccaagaacaagctctaaatgtgtgcttgtattttactgaatcccttttgtaaacccatgcaatattttaccccaatattattgcaatacaaactgggaaagataagatactggaatgtaacctgcatcagacagatagcaatatctcattgatttagagcagagcagaccaagttttggagtagagggagtagttcgatgactggcagagaagcgggtaagaatttaaagacaatagtagaatcattatctctctgctaccctgttgggacaaagctctctaaaataagcaactacacag

SEQ ID NO: 55 - DNA, 471 bp, Homo sapiens
  allele 147: 99-25922-147 : polymorphic base G or T
  misc_binding 135..159: 99-25922-147.probe
  primer_bind 128..146: 99-25922-147.mis
  primer_bind 148..166: 99-25922-147.mis complement
  primer_bind 1..21: 99-25922.pu
  primer_bind 451..471: 99-25922.rp complement
ctctaatatcaataaagcctcaaacatgtttgctgattctaggacatattgtcaatcacgcactcacaggagaattttccatctacctgaaataatttaaatttatcttatatttctctttgatgagaatcatacaaaatggaattkatctgaattcttgtgtttgcagagcacaacatatagcagaactattaaaaaaaatcaagtacatttgtaatagttgaaatacaaaagaagttggccaagatatccccaaatatgctaaaaagtcctctaattgtgatgctgaaagaaacttttctaaactatcaaaaatgaaatgcaaattgtagttagtagggctaaaaaaattactaaattacctttttcttatctctacaaaaaacattacaaataatattttgtcgtatgaagtgtgatcaaagtatatgtaactaaaaactaaggaatcatttatagtttatcaggcag

SEQ ID NO: 56 - DNA, 499 bp, Homo sapiens
  allele 121: 99-25950-121 : polymorphic base G or C
  misc_binding 109..133: 99-25950-121.probe
  primer_bind 102..120: 99-25950-121.mis
  primer_bind 122..140: 99-25950-121.mis complement
  primer_bind 1..19: 99-25950.pu
  primer_bind 479..499: 99-25950.rp complement
ctaccaaatcatcaactaccaaatacctcagtgcattttctagcattaactttatttagtaccagaattatcacagagtctaaagttatttcacacttaattttgtagaaataaatagatstgtagaaatcttccttatggattcaatattttgggaaagaagcctcagtgatggatattttgttgtgttagaagtggctatctattgttactttgtaataaattatcttaaagggtgtttattgtaagtatcacatataatccaggatattttcctttggaagaggcaaacccagttaaattgggaaaaagaatatagtctgcaaatacaaacattgaaaaatgtgacctctgccccttttcaactcttataggacaaattcagaactcaactaaatgaaattctttatattgttaaaaaatttcccctagatctcagacagatgctgagatctgttttgtagcattcacccacgtacctaaatctcactctcagcaa

SEQ ID NO: 57 - DNA, 484 bp, Homo sapiens
  allele 373: 99-25961-376 : polymorphic base A or C
  misc_binding 361..385: 99-25961-376.probe
  primer_bind 354..372: 99-25961-376.mis
  primer_bind 374..392: 99-25961-376.mis complement
  primer_bind 1..20: 99-25961.pu
  primer_bind 464..484: 99-25961.rp complement
  misc_feature 395: n=a, g, c or t
tctcccctgtgaatgggaacatgtatgaatttgaaattatgttctacattctcctccacagttggaaaaggagggaaagacagacacacccctggactcagagggttctgcctgcctcaccaaggtctggaagggtcactttctgccttctttcccttccattctttcttcaaataattgtccatgaaactatatgcagttggagcctgatggtcttccccttaccacctccccaagtgaaaatggkttccttgttgaatttgtgagaagcctttccccaagtctcttgctttgcttgaatcccagagcttagatttccgagaaaataaactatgcagtaggaataggattggtgtggctcctgggacggggmtacacagacaacttatatctcnaaactctggaagacgatcattgtaaacccttgaatgtggcaggggcatggcaggtcactgtgagattagcttctgttaaactgagggct

SEQ ID NO: 58 - DNA, 470 bp, Homo sapiens
  allele 399: 99-25965-399 : polymorphic base A or G
  misc_binding 387..411: 99-25965-399.probe
  primer_bind 380..398: 99-25965-399.mis
  primer_bind 400..418: 99-25965-399.mis complement
  primer_bind 1..21: 99-25965.pu
  primer_bind 451..470: 99-25965.rp complement
ctcaaaatacatatacaccagctttaaatgggaggccaagataacggaaagaaagaatgaggtttcgattgaggatgcttagataagaaaagcgcagagccccctttcctgggtcaagttgcttttcagtgccagctcacctttgtcaacttcctaggtcaaatgtcatgggaaaggaaaataatgatccaaatcagtaactttaaatgatagaataaatagagaaaacaattggctgagagaaagctgactcgattgtaacgtttagctactagagaagatgaaagttcaaagaacttaacatgaagtgtaaggagataataagttttgctcattgttaatttgtctcatgattctgtcaatgcgtactggtcacgtgactttcacaaggaaaatgcrttattcaccacagcagatcatcttcctcattaaaaaccaaaggtacaatgtgggtactgtgacttttagaa

SEQ ID NO: 59 - DNA, 523 bp, Homo sapiens
  allele 241: 99-25966-241 : polymorphic base A or G
  misc_binding 229..253: 99-25966-241.probe
  primer_bind 222..240: 99-25966-241.mis
  primer_bind 242..260: 99-25966-241.mis complement
  primer_bind 1..21: 99-25966.pu
  primer_bind 503..523: 99-25966.rp complement
caatagtgtaaacagccaaccattaaaaacacataaaataagtttcataaagatgaaggtgacacaggagtccagactaaaawgtatgagtatgagttcaggaaaggctttctaagaaggtattatttaacttctgggcattcatatttaagtataggaaaagtcatgtcagtattcaggaaaaatctgagtcatgcttgatggtatgaaagtgtgaggcatgtattgagaatgttcaagrgtcggttgactgccactccttcctccaagctcatagcaaatcccacttcagcacggaactgttcttaaagtccacacttaccgctcttgctccctcattccccatgtgccttgtttatttagaggtagatatattggtcaggtcaggcaagctaagcttcagtaacacatcaacccttacatttcagtggcttcacccagtgaagatttgtttctcacttaggctccaagggtatcttaggctggcaggagatcagctgcacatcatcttcactgactctca

SEQ ID NO: 60 - DNA, 493 bp, Homo sapiens
  allele 56: 99-25967-57 : polymorphic base A or G
  misc_binding 44..68: 99-25967-57.probe
  primer_bind 37..55: 99-25967-57.mis
  primer_bind 57..75: 99-25967-57.mis complement
  primer_bind 1..20: 99-25967.pu
  primer_bind 473..493: 99-25967.rp complement
aacaagtgacatgacaaatgtacattttctctatttggactgttacacagagcctrgattgaaaaggacgaagagaagaagcaggcacaagagaacagctgggctattactataattggaggtgtgagaaagagaaggtcaagaactcctcccagttttctggcaaaaacaagttaaaaacataaaaaaataaaaaaataaattaaaagcaaataaatgtgccaacgacaaagtcagagagtcctagaaggacaagctcgtgagggataggaaggtcaagggttttatttcattgtattaagaatggagattttgctgagccataccgcacagatatctagtcagttggaaacataaatctaagtgaagaacaaagttctgtgctagagataattattcaagaaccattcttaaacaaaatgattatactagaaaagatatatcaattacttttcatacaaaacaaaaaatgcgtattttggcattctgattg

SEQ ID NO: 61 - DNA, 530 bp, Homo sapiens
  allele 200: 99-25969-200 : polymorphic base G or T
  misc_binding 188..212: 99-25969-200.probe
  primer_bind 181..199: 99-25969-200.mis
  primer_bind 201..219: 99-25969-200.mis complement
  primer_bind 1..21: 99-25969.pu
  primer_bind 510..530: 99-25969.rp complement
gttagtgactccttcttttacacatttctggtttcaaagcagattatcaagtaaaattttaaactgccaccaggagatttagctaaggagtaccagctgattttgttctaatgcagtctttaaaataatgtacactgtgacatattcaagtcaagtacagcatttatatgctacacagtcaagtaaactgtgtagcatakaaatcctaccacattctccaaaccagacagagggagaatcacagatgccccatgaatcacctagaaatcctgtcaacatataacaaattatatgtggtagacccataaagtcaatatcaagttaaaagcattttttttgtcctcatgtaaaataaactctggaaggagagaatgatcttcacatgtcaatgaaaatctgagaaaagggaggggtacagaacagagcaaaatcagagttcaattcagaagccataaggaagcaggggagggagccatgcttaccaacagcaaagagtgaagtcaggagtgcagaaaagcaaacaccgtagc

SEQ ID NO: 62 - DNA, 448 bp, Homo sapiens
  allele 315: 99-25972-317 : polymorphic base C or T
  misc_binding 303..327: 99-25972-317.probe
  primer_bind 296..314: 99-25972-317.mis
  primer_bind 316..334: 99-25972-317.mis complement
  primer_bind 1..21: 99-25972.pu
  primer_bind 428..448: 99-25972.rp complement
gacctatgagttcattggttcattccacttaatctagagaattcattttacctagacagacactaaaaaagacacacaggtgcacacacacttaggcataaattgtcagtttttagcccaggtctgtcctattcccattattacatataattggattagaaatgtcattttaaaattattaagctataggtaaggcctttctttgctacatatatatataatcttgacttctttaaaatctagcctagaaaacatttttgtttctttttctctttttcctggtcccttctttagctcccaagaatttcagaaaaytgttgcattttagattattttgccagctgcatacttttctgtctaatttgcagatgtcacttacttgataacacttcacacagctgtctaacccaagcttaaatgattttctgatttctgaagaagtggctac

SEQ ID NO: 63 - DNA, 544 bp, Homo sapiens
  allele 143: 99-25974-143 : polymorphic base A or G
  misc_binding 131..155: 99-25974-143.probe
  primer_bind 124..142: 99-25974-143.mis
  primer_bind 144..162: 99-25974-143.mis complement
  primer_bind 1..21: 99-25974.pu
  primer_bind 524..544: 99-25974.rp complement
gctataatctctccttccttggtagccttggggttgtttattttcttagggttttaagttatttttcttggcctgaaaactcatggtgcctactgtcagagctgcacagaacccagtgctcagccactgcgtgcctccaagcrctgacatcctaacaacagtctgggtctctgaggtcttggagcagagggaggtgagacaaagataacagggtctaaactgtgcctactggaagtctctgctctcaaataataaaaaaacttaaaatgaacaacattttactaaatatagcctgatcactgcatttgcatgggggctggattgatctggaatgatcagagctaacatgaagctcttttctggagatgtgggacatcaaagtcacatactaagaagggatgaagacattgcagtgtatcggtctccctcaccctgtccttctctagcggtaccccctctctgaatcttttcttactggccacaaagaacaaaactctcagtgcaatgccatgacaaatttctccaggaagsytaaccaaatcgt

SEQ ID NO: 64 - DNA, 540 bp, Homo sapiens
  allele 311: 99-25977-311 : polymorphic base A or G
  misc_binding 299..323: 99-25977-311.probe
  primer_bind 292..310: 99-25977-311.mis
  primer_bind 312..330: 99-25977-311.mis complement
  primer_bind 1..21: 99-25977.pu
  primer_bind 520..540: 99-25977.rp complement
caattctctcaaaattgtctcaaataaacaagtattgagccatcgtgatgaattatgtttgttcacaggttattccatttaattttctcttcccacctcattaagatgtaaatagtaactcagcttcatagagaagactgaggctaagagaaaaggattgtccaggctgaaaggttagaaaaaggcagaagctgctcttctactcagatttctgacttcaattccacaaaggtcttaaaattaggaaagcaacacttaagcactttaaatagctatgaaaaatgcaaaatggaatctattcaagcccatgrttctgtgttaattgtgctctgatgattgttctctttctttgcagccccacggtaacggaggtggaagtcagttctacttctctgttgttttgcaaggaatgttcctaggaatattctgttgcaccctgggaacattatcttcatccgtattttaagctttttatagacaagcaaaagaaccatttaaaatatatataccacagcttctgatacagtgttgaaatactac

SEQ ID NO: 65 - DNA, 538 bp, Homo sapiens
  allele 93: 99-25979-93 : polymorphic base A or G
  misc_binding 81..105: 99-25979-93.probe
  primer_bind 74..92: 99-25979-93.mis
  primer_bind 94..112: 99-25979-93.mis complement
  primer_bind 1..19: 99-25979.pu
  primer_bind 518..538: 99-25979.rp complement
  misc_feature 412,462: n=a, g, c or t
cactacagtaatcggagacaatgcagtgacaggattgactacccgtggatcagcctgaagcttcaccttttttttcaaagtgcattttgagartatttgtgctatccattagtaaaaattaccaaagaggagcataatggaagcatagagaaatagtaaaaatagaaacatccagatattctatgaaccctaggaaatttacacaacagtattattattcaatatattgttgtcgtgtggcaccaacgccagagaagaattaattgctgagcaacggcccagacaggagttcccaagaagtaggttcaggtccatgagttgggaacttgctgagttgctgtggatctttgcttctttaaagtgttgtccatggattgcgggcatcatcagtattacctgggatcttcgtagnaatcacagaatcttggtccctaacccagatctgcagaatcagttactgcnggcttcacatgatacccactggatgtgcatgtacattcaagtttgaaatgatggtgtgaatcaggcagcagaaatg

SEQ ID NO: 66 - DNA, 469 bp, Homo sapiens
  allele 194: 99-25985-194 : polymorphic base C or T
  misc_binding 182..206: 99-25985-194.probe
  primer_bind 175..193: 99-25985-194.mis
  primer_bind 195..213: 99-25985-194.mis complement
  primer_bind 1..21: 99-25985.pu
  primer_bind 449..469: 99-25985.rp complement
ctttgcttacaatcaaatgagatacaaggtatttaaacaactaactataatgtttggacatctgtgcttttaaaaatagatagactagttcaaaaaaacacaaataacaaaattcataataagtaaacactttgtcactttgttaagtgttcagtatctataacctacttaggtattatttcagcataatatayattattacattaacgacaaaaaaataaataccttagatctgtacaaaagtatagactgaactagataagacaagagaacatttttatagatttgaactcagagagctctgcacgtcactttaagacatggctgaactgtccaagaagcatctgtgattattggggtgtcctccctgtgaaacttaaaacatattaatctctgacaatcacttgcaatcaggtaagattttcatcctgagctaatgtatgctgtgctgaaaactttactccccatt

SEQ ID NO: 67 - DNA, 553 bp, Homo sapiens
  allele 398: 99-25989-398 : polymorphic base A or G
  misc_binding 386..410: 99-25989-398.probe
  primer_bind 379..397: 99-25989-398.mis
  primer_bind 399..417: 99-25989-398.mis complement
  primer_bind 1..19: 99-25989.pu
  primer_bind 533..553: 99-25989.rp complement
cccatcttatcttcaaatccccatgttacactataggtgcagtaagtataaaacaaacctaattagtattcttagataatgcagacatttaaaaagcacaagtcatttttggaaaacgaagaagtgcaatgccactgagtttaccctgaaatcatgaaaatggcttgatggagtgctaatgtacatatgcttaacaataaaaggtaaaatctctcaccatcacttttggtagtcatttctctccgacccccacatgtaaactaattccagggtaattgcagggtgatagttttgattttctgtattccaagacagtaattcttgagagctatttgcatcacaactactatcagtggctactaactcaaataacagcgataattataataatcattacrtatttactgagtattcactatggactttgctaaccatactcaagcatactgtctttccaagatacaaatgttttagaaaatgaaatttctagaggtaaggccctggcctcattcagattatttcagttcatattgggattkraaaacaactgtga

SEQ ID NO: 68 - DNA, 451 bp, Homo sapiens
  allele 264: 99-26146-264 : polymorphic base G or T
  misc_binding 252..276: 99-26146-264.probe
  primer_bind 245..263: 99-26146-264.mis
  primer_bind 265..283: 99-26146-264.mis complement
  primer_bind 1..19: 99-26146.pu
  primer_bind 436..456: 99-26146.rp complement
ttttacacccatcaaaacctaaaaatccttcatacattttaatatctacccaggaaatgagtttaagtgaatcaattaagaggaaatgaatactcgacttattcagaccgaagttgttatttgggatttgttactagtatgtgtatttttattatgacacaactaatgcagtgatgtgttatgaaacaaatctgagccaaaaagcaggttttgaaatcaacttcacttataaaggcattatcttggctacattatttaatatcktttacatctacagatgcttatcaccttaagatgggattacttccttataattacacatcataaattcaaactattgtaagttgaaatgcatttagtaccttagtaaacctattttaatatcaaaaaaatcccaaattgaactatcttaagttggggaccatctgtagttyyttgcatgaaaaatagg

SEQ ID NO: 69 - DNA, 454 bp, Homo sapiens
  allele 276: 99-26150-276 : polymorphic base A or G
  misc_binding 264..288: 99-26150-276.probe
  primer_bind 257..275: 99-26150-276.mis
  primer_bind 277..295: 99-26150-276.mis complement
  primer_bind 1..19: 99-26150.pu
  primer_bind 437..454: 99-26150.rp complement
gaaagattagttgcatgagataatctgatctctaaaattctgcctttttaatattttatcaagggatccaagaacagttactgcaatattcgtaccacaatcaactttgcaatttgaaaagacaccagcttgttggaggagaatgaattgcgagcggagagagtcagagaggagataagactcagtttgaggaaggcctattgagacatttggttcatgtgacaatctggtgttttgtactgtggtcatttccacggagatggagataaatgagcrtattttggacagtttatttaacagcatactaacttttcatattttgaggtttctaaagttgaacgcatcttctaattgatgacatgtcagtttgatacattgtttttctctgttaaaaacatatgctatgatacatggcatctgagatgcaaagaaatatggtacttttggtggcaca

SEQ ID NO: 70 - DNA, 449 bp, Homo sapiens
  allele 44: 99-26153-44 : polymorphic base A or C
  misc_binding 32..56: 99-26153-44.probe
  primer_bind 25..43: 99-26153-44.mis
  primer_bind 45..63: 99-26153-44.mis complement
  primer_bind 1..19: 99-26153.pu
  primer_bind 429..449: 99-26153.rp complement
atgcttaatgcacatctacrtaatctatataaatcaatcaatcmatctatgtctacctgttcagggtataaaatctttgcatactacgttaacatagtatacaagttccttgtgcaacagatagtgtacagcaattaactgctgtcaagttttatctttcctgtaaaactcccagcacctgcactgaacttcgctggtcaataagtgcattatatacacacccatatgcacatacatwatataatatttttatatgtcaattgctcctctagattgagtccaatgctcagaattataacggtaatttctcaaaaacaaagaaacggaaggaaagaaggaagggggatggagagaagtcagaaacagagaatgagggaagaagaaaggaagtgctgaaaatgtatttggggtgaataaacacatgagatggtataaagaggcaggtaatg

SEQ ID NO: 71 - DNA, 511 bp, Homo sapiens
  allele 290: 99-26156-290 : polymorphic base A or C
  misc_binding 278..302: 99-26156-290.probe
  primer_bind 271..289: 99-26156-290.mis
  primer_bind 291..309: 99-26156-290.mis complement
  primer_bind 1..18: 99-26156.pu
  primer_bind 491..511: 99-26156.rp complement
gatgagtgtgaggtagtgtctcattttggttttgagttttcctaatgattactgacattgaaaatctttttataatgtctatatttataaaattatatttatatagacaaagacccccaaaaacatatttgtctagggccttgtagacccaaggggaagccctgatggattcgaatcctaattccaccacctattagctgtgtagtgttgaatatatctgtaaacctacttgagtatcagaatttttatattggctgcattttaactgtagatagctgttctggagcaamaatactgtaaaattagtcttttcttgaaaaacaggcagaacctagtattgacagatataactattttttgcacccctcttctatatcttatgctattgtccacgagcttattatattgtaacttgatattaattttaagaaagatttgaaattagccatattttagtatgtcagttttccataacaaggaaaaaaaaacacagaataaagatttaagccac

SEQ ID NO: 72 - DNA, 551 bp, Homo sapiens
  allele 189: 99-27345-189 : polymorphic base G or C
  misc_binding 177..201: 99-27345-189.probe
  primer_bind 170..188: 99-27345-189.mis
  primer_bind 190..208: 99-27345-189.mis complement
  primer_bind 1..18: 99-27345.pu
  primer_bind 531..551: 99-27345.rp complement
taacccacacggatttagctagagttctagttagctcatgagtagggacagaactgggtttggagttaattttactctgtacttatgacttaaaaccggattggaattaccttctgagtaagtgttcccatattaccatatctaaattaggtgtttcattttttataactacggtagcatcttctcagsatcaactatataatttttagggcccagtgaaaactgaaactatgatgtccttcactagaaaatgattcagaattttcaggaggtgccagcagagtgttagtccaaaagcaggtccttctacaggacccagaatgatggcacagcctgggaaacaataaagctggccctgcccccttcctcagtatttatcagaacttgtagttgtaatttttataaaatacgtacggtaatttttctgttgcatttgcttgttttctggaaaactgcaagcttcacaacgtgagtgacatgcatactgtatttcttgggtcagctcagcatctagcacagtgcctgatgcagcagmcaccgataaattctgt

SEQ ID NO: 73 - DNA, 514 bp, Homo sapiens
  allele 380: 99-30329-380 : polymorphic base C or T
  misc_binding 368..392: 99-30329-380.probe
  primer_bind 361..379: 99-30329-380.mis
  primer_bind 381..399: 99-30329-380.mis complement
  primer_bind 1..18: 99-30329.pu
  primer_bind 496..514: 99-30329.rp complement
gacataccccaaacacagcagcacaaagcaactgcctgtgattgtcaattatctgcactaactttgaatagacaactgagagtaaaattgaccattagctgttattaatcttttaaatagcttatttatcaggacaatattttctttgaggaatggtttcacatcgttgataaacagtttcctattactaacattaaactaaataatatatgtcatatttcttttttacccttagaaagttaatctaataatattattctgattagtggtactttttttaatttttgtaatgttgtttatggtgtttgatttgtacttttttgtctttttcataccttttaataacatccgatttactactggagcattttattttcatygtctcttaaaatacttaataacttttagatttgttgttcacaaaactaaataattgcttgatgtttcattttatccttcttattaaataggcagctcgtgtacatatgaaagtgtctttttatacaccgaaacc

SEQ ID NO: 74 - DNA, 511 bp, Homo sapiens
  allele 342: 99-31798-344 : variable motif CAT or ACTGTCTCTACCTCA
  primer_bind 1..20: 99-31798.pu
  primer_bind 491..511: 99-31798.rp complement
caacccataacaaatggaaggcagagcccaatggcaaaggtagtgccaaggcagatgtgttccccacagcctagaagttggggagagaggaggcctaaaatgcttccagactgggtctaccatagaggaaggtaagaaggtaagataccttaagattcgggcatggggaaggggcagagaaggaaaattgcatgatctcatactaggtgacctcagtaccagtgaagttttgattggatttgcgagctgatctaagccaactccaacattcaacaatggtaagggaacccttagraattcacttgtaggtaagggctacatatattcttcattacaacctgactgtctctacctcattatgcatttatatccttattatagcagaggtagttatgattaaagtaactatcagactgaaatcctcccaaagggtaaacattattagcaagcaggaaggaaacaagatatgtctaggagagatttttaagtgcagaaatatctccactccgtc

SEQ ID NO: 75 - DNA, 474 bp, Homo sapiens
  allele 159: 99-5873-159 : polymorphic base C or T
  misc_binding 147..171: 99-5873-159.probe
  primer_bind 140..158: 99-5873-159.mis
  primer_bind 160..178: 99-5873-159.mis complement
  primer_bind 11..28: 99-5873.pu
  primer_bind 466..474: 99-5873.rp complement
aaaggagcaggcgtaacaataagcagggttagtcgccacaaaacttgagataagaggaaaactaaaaaagtctaatgaaatcagtagtcttaaaaagatgacatgataggaagagaagtgttaaaaaagaaaaaaaataggtatgaaagagagtaacayataccggaaaagggataaaatacatcctttgaaagaacaaagagttattcaaattgaattcttaatgaattacttaaacagcagattagatattgttaaaaagaggaatagggaattaaatgatatatgtgatgatattacctagtgtaaccatcaaagatgtattgcaaatgataaagaaaaaaatgctgccatggcaatattaatatcataaaaatatactttaagaagtaaataaatgcaactaggaatagagaaagctaatgaataataatatttaaaaaaaagtataacaagtatacataagatgtaata

SEQ ID NO: 76 - DNA, 490 bp, Homo sapiens
  allele 220: 99-6012-220 : polymorphic base G or T
  misc_binding 208..232: 99-6012-220.probe
  primer_bind 201..219: 99-6012-220.mis
  primer_bind 221..239: 99-6012-220.mis complement
  primer_bind 11..29: 99-6012.pu
  primer_bind 477..490: 99-6012.rp complement
attgtatttagtcttgacttgttttcctgagggtccaggttgatttgcatgctcttgaggaaatatacacgtcttctcagttttaataattgactgacagccctgtggtttctcaggacccagtgagctgctgctcccaggtcagtctgcaaaggatgctggttcccttgtggtctcatcaaggtgaggaatttcctgattttagagatttctttatcckaattttgaagactttctttcacatttctaggcataaaaaaatgtacagcactctactgcttgtttaacaaatggatagtgatatatctgccaacaaagaccacatggagtatttcattgactatcagagaagtttcctcgaaaggcaccatacttagtgttttatttccatgagtgaaggaaaattagttatttgaagtatttggctgtctttagttgtttctaaagtagtgctgattttatatgcccataatattcatatatacaccca

SEQ ID NO: 77 - DNA, 529 bp, Homo sapiens
  allele 99: 99-6080-99 : polymorphic base C or T
  misc_binding 87..111: 99-6080-99.probe
  primer_bind 80..98: 99-6080-99.mis
  primer_bind 100..118: 99-6080-99.mis complement
  primer_bind 11..28: 99-6080.pu
  primer_bind 519..529: 99-6080.rp complement
acaacaacaaaaatgtgtccctgaaacccatgctatattcaactgaatattctaatgtctttgattacaaagccatctctagcaatttaatacaattaygaaatggaaaagttggcaaatgcaaaacaatagctcgtgttcaaggtatgtctttattaggggaagtttatcgaaacagatgtttatgctatttcctataaactagattctaaaatattttattctataaagatgtattgactttatatgaaaaaattattgaaaaatctacaagatggtgaaactctttagaactatatttctattacaagtttatttttaatttcaaaaatgtactgcataaatgcagcaaaacctttattgtcacatattaaaacatgtacattattgtgtgcaaattaaaatttcattaccttaaaccaaaaagtgagttggccagatagtaaataatttaggctctaaggctgaaaagcgcttgtattaattactcaactccaccactattttgccaaagcagtcacagacaata

SEQ ID NO: 78 - DNA, 489 bp, Homo sapiens
  allele 156: 99-7308-157 : polymorphic base C or T
  misc_binding 144..168: 99-7308-157.probe
  primer_bind 137..155: 99-7308-157.mis
  primer_bind 157..175: 99-7308-157.mis complement
  primer_bind 1..18: 99-7308.pu
  primer_bind 469..489: 99-7308.rp complement
tgtggtctggatatggtgractgtccttcacacacagatgtgggaagccatgatcatcagttgcattattcctgaggggcaatgcattccagttacatagaaccagtttctacgtttcagggtatatgtattcatggtgacaaatttattcacatyttaagtaattttaagtaattcacattttaagtaattttcctgaatgtgcctcattggcttctgtgcctcttcagaaaagatgaactaaacactggcatatgtgttcagatttcaacattccgttgttttcattgtggataatttctgtcccatatttttgtgtaaagttagacaataaagtgttaatattctggcgtcggcacattttctttcctgataaataacaattcacatatctttttaaaatatcagagaatatagtaaccaatttccaattcttttttcaccatgtatctattggagttttaaaatgactaatactaaggcaactat

SEQ ID NO: 79 - DNA, 112 bp, Pan troglodytes
tcccagtgggattcaaccactcatagactgcttttgttcaaactgcgttcaaataaggcaaacgccgagctggaaccaatctcactgtttctgtacctcgcttctaattcct

SEQ ID NO: 80 - DNA, 118 bp, Pan troglodytes
tttcagaaaacaaaaactcctaagagaatgaatagaaattatcttaaggaattataaagaaccatctcagaattttactctgttactgcaaaatctcatgcaaagataaccaagtatg

SEQ ID NO: 81 - DNA, 146 bp, Pan troglodytes
ttgcaggtccacattcgttctagaggctgcctgcggtccttagaggccactcatagttccttgccatgaagacttttccaacatggctgcttacttcttaaagcctgtaaggagatccagtctcagttggccaagtcttgtaaaag

SEQ ID NO: 82 - DNA, 94 bp, Pan troglodytes
gaaaataacgcatttataaaacccagctcagatgttacttccaaccaacaaatttcctggacacactaagtaatagagttaatcacactgtcct

SEQ ID NO: 83 - DNA, 229 bp, Pan troglodytes
ttgcaggtccacattcgttctagaggctgcctgcggtccttagaggccactcatagttccttgccatgaagacttttccaacatggctgcttacttcttaaagcctgtaaggagatccagtctcagttggccaagtcttgtaaaaggtaacctcatcaccggagtcacgtctcatcacctttcccatgttccattggttagaagtcccagctcctgcccacattcaagg

SEQ ID NO: 84 - DNA, 205 bp, Pan troglodytes
tgaaggtctccctgctgtgcttagagagggggatgctggaagaagagtggtcagagaagcaacattgctggctctaaagacagaggacaggccacgagccaaggcatgcaggaggcctccagaagctggggcaggcaagagaatggactcagccctggagcctccagaaggcacgcagccctgcccattccttgcttttagccag

SEQ ID NO: 85 - DNA, 82 bp, Pan troglodytes
aaacaatacgaacagaaacaaagctatgtacttgttttgggaagcaacctcaaatggaaagatgggggctgtgttctaaaag

SEQ ID NO: 86 - DNA, 234 bp, Pan troglodytes
gaacattcactctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacatcctgccatgccctttccaaatcctggaccaacagaatcatcatatacacta

SEQ ID NO: 87 - DNA, 714 bp, Pan troglodytes
gaacattcactctgggagctctgtgctgccatgcaaatgtcacattgcactgaggccgccatgctgtaaaaaaccccaagctacctacctgaaaagctggagagaatcagcacccatcagcttttccagcattttgggtcctcccagctaaatcatcggcattgtgaagcagagatgagacatcctgccatgccctttccaaatcctggaccaacagaatcatcatatacactagtgagcttttactttaagccactaatttggggtgtagctcttttgcagcaaaagataatcagaacactgccatgcaggagctgagaaacttgctcactgttatgcgtgtatccaatgactactcacacacacattacttgcttcactctgctttctggctttccattcagcaaattttaagaaatgaaaaagttattcatgggaaattaactcaagatgaatattgttgtagttaatctctttgtaaatggtaaaatattaaattattgtgagtcatttttatttaaagaagtttggttctttaaatgaaaaaagtttgggtcttttgtggatactttgcatatagacattctagacatgaaagaatgttgaagacaaagaatgttgaaggaatatagacatgaaagaatgttgaagtttggttttttgtggatactctgcatatagacattctagactggagtgatacatcttgttcag

SEQ ID NO: 88 - DNA, 220 bp, Pan troglodytes
acatgaaagaatgttgaagtttggttttttgtggatactctgcatatagacattctagactggagtgatacatcttgttcaggtttctatgttttcaaaatgataacttgacacacctaccaatgccaatttttaggatatatatctgtatatctgtgtgaactaaggaaaattcaggtatgattaaacctacatattttgccaggagagactggataat

SEQ ID NO: 89 - DNA, 173 bp, Pan troglodytes
  misc_feature 91..92,131: n=a, g, c or t
ggtcctgatcttcccagtgacttagcagcacagtaatttggctgaaatgttgatgagttcagacaagaagaaggtgatgatgacaagaganncgtcacggggaaattctgccctgaggaaggaatagtttnaggctggagagatgtgctacccccgccactctttctcaaatg

SEQ ID NO: 90 - DNA, 1105 bp, Pan troglodytes
  misc_feature 201,744,803,808..809: n=a, g, c or t
gaaagacaacctgtaggcacagaaatcattgctctgcttacactgaaatctcctgctgactttgagagctgagcactggattttgatgggagagtgaaacttagtgaaggaatgatttgaacctttgttgatctaatacttctgtgatacagttatctaaacagaatgagtctaaagtcagtataaagacctgtgtctctncatgttttgctacttataattgcagaggaacattttgagatagaaaattttatccccctttcaagtgactttttataaaacataaccttttaagagaggtcattcttttgaaaaattgtctgaatacaagagaagtaactgaacagcaagggattgtagccataatgttcttgaccactttagattgacaaatagtgtctcaaaattgatcaggttctggagaatctattgaggttgtatggagtaaccaagtgatggaagaggttggaagtgaataattttatgtggtattatgtgattttttttggtgggggtagtgtctggagctgagcatgatggggcctagatggggcagccttctaatgctcccagtatttcgcaaatcatatgtcacgtcaaaattgtaatgacaaagctcacagcagctgcctacgccaggtttggtgccagctctaattagagcatcgatcatttctctccccttcatgaatgcacgtgcgtgcacattttcatatacaagggcaaaggacatttcaaagtttnggatggaatctttcctacttagaagtaataaaaagcaatactttgaaatcttaccaaanattanncaaatagcaacaatttttccatttaaagatgtgtgtcttcaggtctgttggatctttcaaatttctattttggacatggaaactacagatgaaatttaacttactcaaagttacacagaactcctggctgatctcttttacttaattcttctaaaattttaagtaagaataattttgaaatgttattggtaatgcttaaataacaaaagttactttaatatgttacatgttggaagtttcatttatacttaatatctaatttaactcttgtgaatatattattcagtttttttttt

SEQ ID NO: 91 - DNA, 114 bp, Hylobates sp.
  misc_feature 45,75: n=a, g, c or t
tcccagtgagattcaaccactcatagactgcttttgtccaaactngcgttcaaataaggcaaacgccgagctggnaacccatctcactgtttctgtacctcacttctgattcct

SEQ ID NO: 92 - DNA, 117 bp, Hylobates sp.
ttttagaaaacaaatctcctaagagaatgaatagaaattatcttaaggaattataaagaaccatctcagaattttactctgttactgcaaaatctcatgcaaagatagccaagtatg

SEQ ID NO: 93 - DNA, 146 bp, Hylobates sp.
ttgcaggtccacattcgttctagaggctgcctgcagtccttagaggccactgatacttccttgccatgaggacttttccaacatggctgcttacttcttcaagcctgtaaggagatctggtctcagttggccaagtcttgtgtaag

SEQ ID NO: 94 - DNA, 229 bp, Hylobates sp.
ttgcaggtccacattcgttctagaggctgcctgcagtccttagaggccactgatacttccttgccatgaggacttttccaacatggctgcttacttcttcaagcctgtaaggagatctggtctcagttggccaagtcttgtgtaaggtaacctcatcaccggagtcacgtctcatcacctttcccaagttccattggttagaagtcccagctcctgcccacattcaagg

SEQ ID NO: 95 - DNA, 205 bp, Hylobates sp.
  misc_feature 187: n=a, g, c or t
tgaagttctccctgctgtgctcagagaggggggtgctggaagaagagtggtcagagaagcaacattgctggctctaaagagagaggacaggccacgagccaaggcatgcaggaggcctccagaagctggggcaggcaagagaatggactcggccctgcagcctccagaaggcatgcagccctgcccnttccttgcttttagccag

SEQ ID NO: 96 - DNA, 234 bp, Hylobates sp.
gaacattcactctgggagctctgtgctgccatgcaaatgtcagattgcactgaggccaccatgctgtaagaaacctcaagctaccaacctgaaaagctggagagaatcagcacccatcagcttttccagccttttgggtcctcccggctaaatcataggcattgtgaagcagagatgagacctcctgccatgccctttccaaatcctggaccaacagaatcatcatatacaata

SEQ ID NO: 97 - DNA, 715 bp, Hylobates sp.
gaacattcactctgggagctctgtgctgccatgcaaatgtcagattgcactgaggccaccatgctgtaagaaacctcaagctaccaacctgaaaagctggagagaatcagcacccatcagcttttccagccttttgggtcctcccggctaaatcataggcattgtgaagcagagatgagacctcctgccatgccctttccaaatcctggaccaacagaatcatcatatacaataggaagcttttactttaagccactaatttggggtgtagttcttatgcagcaaaagataatcagaacactgccatgcaggagctgataaacttgcttactattatgtgtatatccaatgactactcacacacacatttcttgcttcactctactttctggctttccattcagcaaattttaagaaatgaaaatgttattcatgggaaattaactcaagatgtatattgttgtagttaaactctttgtaaatggtaaaatattaaattattgctaatcatctttatttaaagaagtttggttctttaaatgaaagaagtttgggtcttttgtggatactctgcatatagacattctagacatgaaagaatgttgaagacaaagaatgtggaaggcatatagacatgaaagaatgttgaagtttggttcttttgtggatactctgcatatagacattctagactggagtgatatatcttgttcag

SEQ ID NO: 98 - DNA, 213 bp, Hylobates sp.
acatgaaagaatgttgaagtttggttcttttgtggatactctgcatatagacattctagactggagtgatatatcttgttcaggtttctatgtttttaaaatgataacttgacacacctaccaatgcaaatttttaggatatatatctgtgtgaactaaggaaaattcaggaatgattaaacctacatattttctcaggagagactggataat

SEQ ID NO: 99 - DNA, 209 bp, Hylobates sp.
  misc_feature 26..27: n=a, g, c or t
ggttttgtgcatttctaagatgatcnncttggtgtggggtcctgatcttcccagtgacttagcagcacagtaatttggctgaaatgttgatgagttaagacaagaagaaggtgacgctgacaagagagcgtcaaggggaaattctgccctgaggaaggaatagtttgaggctggagagatgtgctacccccgccactctttctcaaatg

SEQ ID NO: 100 - DNA, 1415 bp, Hylobates sp.
  misc_feature 343,383,387,570,1118: n=a, g, c or t
gaaagaaaacctgtaggcacagaaatcattgctctgcttacactgaaatctcctgctgactttgagaggtgagtgttggattttgatggaagggtgaaacttagtgaagaaatgatttgaacctttgttgatcgaatacttctgtgatacagttatctaaacagaatgagtctaaggtcagtataaagacctgtgtctcttcgtgttttgctacttataattgcagaggaacgttttgagatagaaaattttatcccactttcaagtgactttttataaaacataaccttttaagagagttcattcttttgaaaaattgtctgaatacaagaaaagtaactgnaacagcaaggattgtagccataatgttcttgaccactttnagantgacaaatagtgtctcaaaattgatcaggtgccacagaatctatagaggttgtatggagtaaccaactgatggaagaggttggacacatctgaataattttatgtggtattatgtgatgttattttggtggggtagtgtctggagctgagcatgatggggcctagatggggcagccttctaangctcccaacatttcccaaatcatatgtcatctcaaaattgtaatgacaaagctcacagcagctgcctacaccaggtttggtgccagctctaattagagcatcgagcatttctctccccttcatgaatgcacatgcgtgcacattttcatatatgagggcaaaggacatttcaaagtttggttggaatctttcctacttagaagtaataaaaacaatactttgaaatcttaccaaatattaaacaaatagcaacaatttttccatttaaaggtgtgtgtcttcaggtctgttggatctgtcaaatttctattttggacatggaaaccacagatgaaatttaacttacacaaagttacacagaactcctggctgatctcttttacttaattcttctaaaacctaaagtaagaataattttgaaattttattggtaatgcttaaataacagttactttaatatattacatgtttgaagattttcatttatacttaatatcgaatttaacttgtgaaaatattattcagtattttgttttgttttgttttcnaaaatgacttgttcagggctccttttgggattttaagtgagaaaaactctatttcataatattgttaccatgctcatccaataacacttcatagatggttagccatctctaaaattaaattttgtagttgagggccattgaaaataccacctatattgggatttctgtttaacacttcaaaatgtatcattatcataatttaaaattagatttaaatacaagcctctttatagaaaacctgataaatatggctttatttgtttgcttgttttttttgcagggagggatattcccttg

SEQ ID NO: 101 - DNA, 112 bp, Gorilla gorilla
  misc_feature 99: n=a, g, c or t
tcccagtaggattcaaccactcatagactgcttttgttcaaactgcgttcaaataaggcaaacgccgagctggaaccaatctcactgtttctgtacctngcttctaattcct

SEQ ID NO: 102 - DNA, 118 bp, Gorilla gorilla
tttcagaaaacaaaaactcctaagagaatgaatagaaattatcttaaggagttataaagaaccatctcagaattttactctcttactgcaaaatctcatgcaaagataaccaagtacg

SEQ ID NO: 103 - DNA, 146 bp, Gorilla gorilla
ttgcaggtccacattcgttctagaggctgcctgcggtccttagaggccactcatagttccttgccatgaagacttttccaacatgactgcttacttcttcaagcctgtaaggagatccagtctcagtcggccaagtcttgtaaaag

SEQ ID NO: 104 - DNA, 94 bp, Gorilla gorilla
gaaaataacgcatttataaaacccagctcagatgttacttccaaccaacaaatttcctggacacactaagtaatagagttaatcacaccgtcct

SEQ ID NO: 105 - DNA, 229 bp, Gorilla gorilla
ttgcaggtccacattcgttctagaggctgcctgcggtccttagaggccactcatagttccttgccatgaagacttttccaacatgactgcttacttcttcaagcctgtaaggagatccagtctcagtcggccaagtcttgtaaaaggtaacctcatcaccggagtcacgtctcatcacctttcccatgttccattggttagaagtcccagctcctgcccacattcaagg

SEQ ID NO: 106 - DNA, 205 bp, Gorilla gorilla
tgaaggtctccctgctgtgcttagagagggggacgctggaataagagtggtcagagaagcaacattgctggctctaaagacagaggacaggccacgagccaaggcatgcaggaggcctccagaagctggggcaggcaagagaatggactcagccctggagcctccagaaggcacacagccctgcccgttccttgcttttagccag

SEQ ID NO: 107 - DNA, 82 bp, Gorilla gorilla
aaacaataccaacagaaacaaagctatgtacttgttttgggaagcaacatcaaatggaaagacgggggctgtgttctaaaag

SEQ ID NO: 108 - DNA, 234 bp, Gorilla gorilla
  misc_feature 192: n=a, g, c or t
gaacattcactctgggagctctgtgctgccatgcaaatgtcacattgcactgaggccgccatgctgtaaaaaaccccaagctacctacctgaaaagctggagagaatcagcacccatcagcttttccagcattttgggttctcccagctaaatcattggcattgtgaagcagagatgagacctcctgccatnccctttccaaatcctggaccaacagaatcatcatatacaata

SEQ ID NO: 109 - DNA, 714 bp, Gorilla gorilla
  misc_feature 192: n=a, g, c or t
gaacattcactctgggagctctgtgctgccatgcaaatgtcacattgcactgaggccgccatgctgtaaaaaaccccaagctacctacctgaaaagctggagagaatcagcacccatcagcttttccagcattttgggttctcccagctaaatcattggcattgtgaagcagagatgagacctcctgccatnccctttccaaatcctggaccaacagaatcatcatatacaatagtaagcttttactttaagccactaatttggggtgtagctcttttgcagcaaaagataatcagaacactgccatgcaggagctgataaacttgctcactgttatgtatgtgtccaatgactactcacacacacattacttgcttcactctgctttctggctttccattcagcaaatttgaagaaatgaaaaagttattcatgggaaattaactcaagatgaatattgttgtagttaatctctttgtaaatggtaaaatattaaattattgtgagtagtttttatttaaagaagtttggttctttaaatgaaagaagtttgggtcttttgtggatacgttgcatatagacattctagacatgaaagaatgttgaagacaaagaatgttgaaggaatatagacatgaaagaatgttgaagtttgtttttttgtggatactctgcatatagacattctagactggagtgatacatcttgttcag

SEQ ID NO: 110 - DNA, 220 bp, Gorilla gorilla
  misc_feature 122: n=a, g, c or t
acatgaaagaatgttgaagtttgtttttttgtggatactctgcatatagacattctagactggagtgatacatcttgttcaggtttctatgtttttaaaatgataacttgacacacctaccnatgccaatttttagggtatatatctgtatatctatgtgaactaaggaaaattcaggaatgattaaacctacatattttgccaggagagaccggataat

SEQ ID NO: 111 - DNA, 209 bp, Gorilla gorilla
  misc_feature 97,115,117,130,134,160,193: n=a, g, c or t
ggttttgtgcatttctaagatgatcatcttggtgtggggtcctgatcttcccagtgacttagcagcacagtaatttggctgaaatgttgatgagttnagacaagaagaaggtgangntgacaagagagcntcanggggaaattctgccctgaggaaggantagtttgaggctggagagatgtgctacccccgncactctttctcaaatg

SEQ ID NO: 112 - DNA, 1105 bp, Gorilla gorilla
  misc_feature 959: n=a, g, c or t
gaaagaaaacctgtaggcacagaaatcattgctctgcttatactgaaatctcctgctgactttgagagctgagcattggattttgatgggagagtgaaacttagtgaagaaatgatttgaacctttgttgatctaatacttctgtgatacagttatctaaacagaatgagtctaaagtcagtataaagacctgtgtctctccatgttttgctacttataattgcagaggaacattttgagatagaaaattttatccccctttcaagtgactttttataaagcgtaaccttttaagagaggtcattcttttgaaaaattgtctgaatacaagagaagtaactgaacagcaagggattgtagccataatgttcttgaccactttagattgacaaatagtgtctcaaaattgatcaggttccggagaatctattgaggttgtatggaataaccaagtgatggaagaggttggaagtgaataattttatgtggtattatgtgatgtttttttggtgggggtagtgtctggagctgagcgtgatgggccctagatggggcagccttctaatgctcccagcatttcgcaaatcatatgtcacgtcaaaattgtaatgacaaagctcacagcagctgcctacgccaggtttggtgccagctctaattagagcatcgatcatttctcacgccttcatgaatgcacatgtgtgcacattttcatatataagggcaaaggacatttcaaagtttggatggaatctttcctacttagaagtaataaaaaacaatactttgaaatcttaccaaatattaaataaatagcaacaatttttccatttaaagatgtgtgtcttaaggtctgttggatctttcaaatttctattttggacatggaaactacagatgaaatttaactgacacaaagttacacagaactcctggctgatctgttttacttaattctnctaaaatctaaagtaagaataattttgaaattttattggtaatgcttaaataacaaaagttactttaatatgttacatgtttgaagtttcatttatacttaatatctaatttaactcttgtgaaaatattattcagtatttttttt

SEQ ID NO: 113 - DNA, 112 bp, Pongo pygmaeus
  misc_feature 69..71,99,106: n=a, g, c or t
tcccagtgggattcaaccactcatagactgcttttgttcgaactgcgttcaaataaggcaaacgccgannnggaaccaatctcactgtttctgtacctnacttatnattcct

SEQ ID NO: 114 - DNA, 118 bp, Pongo pygmaeus
tttcagaaaacaaaaactcctaagagaatgaatagaaattatcttaaggaattataaagaaccgtctcagaattttcctctgttactgcaaaatctcatgcaaagatgaccaagtatg

SEQ ID NO: 115 - DNA, 146 bp, Pongo pygmaeus
ttgcaggtccacattcgttctagaggctgcctgcagtccttagaggtcactcatagttcattgccatgaggacttttccaacatggctgcttacttcttcaagcctgtaaggagatctggtctcagttggccaaatcttgtataag

SEQ ID NO: 116 - DNA, 94 bp, Pongo pygmaeus
ggaaataacgcatttataaaacccagctcagatattacttccaaccaacaaattgcctggacacactaagtaatagagttaatcacaccatctt

SEQ ID NO: 117 - DNA, 229 bp, Pongo pygmaeus
ttgcaggtccacattcgttctagaggctgcctgcagtccttagaggtcactcatagttcattgccatgaggacttttccaacatggctgcttacttcttcaagcctgtaaggagatctggtctcagttggccaaatcttgtataaggtaacctcatcaccggagtcatgtctcatcacctttcccgtgttccattggttagaagtcccagctcctgcccacattcaagg

SEQ ID NO: 118 - DNA, 234 bp, Pongo pygmaeus
gaacattcactctgagagctctgtgctgccatgcaaatgtcagattgcactaaggccgtcatgctgtaagaaaccccaagctacctacctgaaaagctggagagaatcagcacccatcagcttttccagccctttgggtcctcccagctaaatcataggtattgtgaagcagagatgagacctcctgccatgccctttccaaatcctggaccaacagaatcatcatatacaata

SEQ ID NO: 119 - DNA, 599 bp, Pongo pygmaeus
gaacattcactctgagagctctgtgctgccatgcaaatgtcagattgcactaaggccgtcatgctgtaagaaaccccaagctacctacctgaaaagctggagagaatcagcacccatcagcttttccagccctttgggtcctcccagctaaatcataggtattgtgaagcagagatgagacctcctgccatgccctttccaaatcctggaccaacagaatcatcatatacaatagtaagcttttactttaagccactaatttggggtgtagttcttttgcagcaaaagataatcagaacactgccatgcaggagctgataaacttgttcactgttatgtatgtatccaatgactactcacacacacattacttgcttcactctactttctggctttccattcagcaaattttaagaaatgaaaatgttattcatgggaaattaactcaagatgaatattgttgtagttaatctctttgtcaatggtaaaatattaaattattgtgagtcacttttatttaaagaagtttggttctttaaatgaaagaagtttgggtcttttgtggatactctgcatatagaccttctagactggagtga

SEQ ID NO: 120 - DNA, 198 bp, Pongo pygmaeus
gaagtttgggtcttttgtggatactctgcatatagaccttctagactggagtgatatatcttgttcaggtttctatgtttttaaaatgataacctgacacacctaccattgccaatttttaggatatatatctgtgtgaactaaggaaagttcaggaatgattaaacctacatattttgccaggagagactggataat

SEQ ID NO: 121 - DNA, 152 bp, Pongo pygmaeus
  misc_feature 73: n=a, g, c or t
tgacttagcagcacagtaatttggctgaaatgttgatgagttcagacaagaaggtgatgatgacaagacagcntcacggggaaattctgccctgaggaaggaatagtttgaggctggagagatgtgctacccccgccactctttgtcaaatg

SEQ ID NO: 122 - DNA, 119 bp, Macaca mulatta
  misc_feature 70,81,83,85,88,93: n=a, g, c or t
tgtcagaaaacaaaaactcctaagagaattaatagaaattatcttaaggaattataaagaacccatctcncagaaatttantntnttnacggnaaaatctcatgcaaagataaccaagt

SEQ ID NO: 123 - DNA, 146 bp, Macaca mulatta
tagtacgtccacattcattctagatgctgcctgaagtccttagatgcctctcatagttccttgccatgagcacttttccaacatggctgatgactgcttcaagcctgtaaggagatctggtctcagttggccaagtcttggataat

SEQ ID NO: 124 - DNA, 74 bp, Macaca mulatta
  misc_feature 6,37,48,56: n=a, g, c or t
ctcagnatattacctccaacctacaaatttcctgggnacacactaagntaataagnagttaatcacaccgtcct

SEQ ID NO: 125 - DNA, 229 bp, Macaca mulatta
tagtacgtccacattcattctagatgctgcctgaagtccttagatgcctctcatagttccttgccatgagcacttttccaacatggctgatgactgcttcaagcctgtaaggagatctggtctcagttggccaagtcttggataatgtaacctcatcaccggagtcacgtctcatcacctttcccatgttccattggttagaagtcccagcttctgcccacattcaaga

SEQ ID NO: 126 - DNA, 202 bp, Macaca mulatta
  misc_feature 127..128,130..131: n=a, g, c or t
tgaaggtctccctgctgtgctgagagaggggcatgctggaagaagagtggtcagagaagcaacattgctggctctaaagacagaggacaggccatgaaccaaggcatgcaggcggcctccgaaagcnngnncaggcaagagaatggactctgccctggagcctccagaacgcgtgcagccctgcccattccttgcttttagc

SEQ ID NO: 127 - DNA, 82 bp, Macaca mulatta
  misc_feature 6,8,30,52,72: n=a, g, c or t
aaacantnccaacagaaacaaagctttgtncttgttttgggaagcaacctcnaatggtaagatgggggctgngttctaaaag

SEQ ID NO: 128 - DNA, 243 bp, Macaca mulatta
gaacattcaccgtggctgctctgcgctgccatacaatgtcagattgcactgaggccgccatgctgtaagaaaccccaagctgcctgcctgaaaagactggagagacacagcacccatcagcttttccagccttttgggtcctcccagctaaattacaggcattgtgaagcagagatgagaagagatgagacctcctgcgtgccctttccaaatcccggctcagcagaatcatcctacacaata

SEQ ID NO: 129 - DNA, 727 bp, Macaca mulatta
gaacattcaccgtggctgctctgcgctgccatacaatgtcagattgcactgaggccgccatgctgtaagaaaccccaagctgcctgcctgaaaagactggagagacacagcacccatcagcttttccagccttttgggtcctcccagctaaattacaggcattgtgaagcagagatgagaagagatgagacctcctgcgtgccctttccaaatcccggctcagcagaatcatcctacacaatagtaagtttttacttgaagccactaatttggggagtagttcttatgcagcaaaagataatcagaacactgcgccatggcaggagctgataaacctgctcactgttacgcgtgtatccaatgactactcacacacacatgacttgcttcactctactttctggctttccactcagcaaattttaagaaatgagaatgttattcatgagaaattaactcaagatgaatattgttatcgttaaactcttcgtaaatggtaaaatactacattattgctagtcatttttatttaaagaagtttggttctttaaatgaaagaagtttgggtcttttgtggatactctgcatatagatattctagacatgaaagaacgttgaagacaaagaatgttgaaggcatatagacatgaaggaattttgaagttgggttcttttgtggatactctgcatatagacattctagactggagtgatatgtcttgttcaa

SEQ ID NO: 130 - DNA, 214 bp, Macaca mulatta
acatgaaggaattttgaagttgggttcttttgtggatactctgcatatagacattctagactggagtgatatgtcttgttcaagcttctatgtttttaaaatgataacttgacacacctacccaatgccaatttttaggacataaatctgtgtgaactaaggaaaattcaggaatgattaaacctacatattttcccaagagagactggataac

SEQ ID NO: 131 - DNA, 77 bp, Macaca mulatta
agagcgtgacggggaaattctgccctgaggaaggaatagtttgaggctggagagatgtgctacccccgccactcttt

SEQ ID NO: 132 - DNA, 306 bp, Macaca mulatta
taaaatgacttgttcagggctccttttgggattttaagtgagaaaaactctatttcataataatgttaccacgctaatccaataacacttcatagatggttagccatctctaaaattaaattttgtagttgaggagcatggaaaataccacctatatttggatttctgtttaacacttcaaaatccattattatcataatttaaaattagatttaaatacaaacctctttatagaaaagctgataaatgtgattttatttgtttgcttgtttttttgcagggagggatattcccttgataccactc

SEQ ID NO: 133 - DNA, 18 bp, Artificial Sequence
  sequencing oligonucleotide PrimerPU
tgtaaaacgacggccagt

SEQ ID NO: 134 - DNA, 18 bp, Artificial Sequence
  sequencing oligonucleotide PrimerRP
caggaaacagctatgacc

What is claimed is:

1. An isolated, purified and recombinant polynucleotide comprising a contiguous span of at least 30 nucleotides between nucleotide positions 199122 to 249803 of SEQ ID NO:1, wherein said contiguous span comprises the biallelic marker shown as A56.

2. The polynucleotide of claim 1, wherein said contiguous span comprises at least one of the following nucleotide positions of SEQ ID No 1: 201123 to 201234, 201123 to 201560, 214676 to 214793, 215702 to 215746, 216836 to 216994, 216836 to 217077, 217671 to 217764, 227655 to 227736, 238715 to 238919, 240440 to 240673, 240440 to 241153, 241072 to 241291, 244353 to 244561 and 246273 to 247802.

3. A recombinant vector comprising the polynucleotide of claim 1 or 2.

4. A host cell comprising a recombinant vector according to claim 3.

5. A diagnostic kit comprising the polynucleotide according to claim 1 or 2.

6. The polynucleotide of claim 1, wherein said contiguous span is at least 40 nucleotides.

7. The polynucleotide of claim 1, wherein said contiguous span is at least 50 nucleotides.

8. The polynucleotide of claim 1, wherein said contiguous span is at least 70 nucleotides.

9. The polynucleotide of claim 1, wherein said contiguous span is at least 80 nucleotides.

10. The polynucleotide of claim 1, wherein said contiguous span is at least 100 nucleotides.

11. The polynucleotide of claim 1, wherein said contiguous span is at least 250 nucleotides.

12. The polynucleotide of claim 1, wherein said contiguous span is at least 500 nucleotides.

13. The polynucleotide of claim 1, wherein said contiguous span is at least 1000 nucleotides.

14. The polynucleotide of claim 1, wherein said contiguous span is at least 2000 nucleotides.

15. The polynucleotide of claim 2, wherein said contiguous span comprises nucleotide positions 201123 to 201234 of SEQ ID NO:1.

16. The polynucleotide of claim 2, wherein said contiguous span comprises nucleotide positions 201123 to 201560 of SEQ ID NO:1.

17. The polynucleotide of claim 2, wherein said contiguous span comprises nucleotide positions 214676 to 214793 of SEQ ID NO:1.

18. The polynucleotide of claim 2, wherein said contiguous span comprises nucleotide positions 215702 to 215746 of SEQ ID NO:1.

19. The polynucleotide of claim 2, wherein said contiguous span comprises nucleotide positions 216836 to 216994 of SEQ ID NO:1.

20. The polynucleotide of claim 2, wherein said contiguous span comprises nucleotide positions 216836 to 217077 of SEQ ID NO:1.

21. The polynucleotide of claim 2, wherein said contiguous span comprises nucleotide positions 217671 to 217764 of SEQ ID NO:1.

22. The polynucleotide of claim 2, wherein said contiguous span comprises nucleotide positions 227655 to 227736 of SEQ ID NO:1.

23. The polynucleotide of claim 2, wherein said contiguous span comprises nucleotide positions 238715 to 238919 of SEQ ID NO:1.

24. The polynucleotide of claim 2, wherein said contiguous span comprises nucleotide positions 240440 to 240673 of SEQ ID NO:1.

25. The polynucleotide of claim 2, wherein said contiguous span comprises nucleotide positions 240440 to 241153 of SEQ ID NO:1.

26. The polynucleotide of claim 2, wherein said contiguous span comprises nucleotide positions 241072 to 241291 of SEQ ID NO:1.

27. The polynucleotide of claim 2, wherein said contiguous span comprises nucleotide positions 244353 to 244561 of SEQ ID NO:1.

28. The polynucleotide of claim 2, wherein said contiguous span comprises nucleotide positions 246273 to 247802 of SEQ ID NO:1.

29. A host cell recombinant for the polynucleotide of claim 6.

30. A host cell recombinant for the polynucleotide of claim 10.

31. A host cell recombinant for the polynucleotide of claim 10.

32. A host cell recombinant for the polynucleotide of claim 12.

33. A host cell recombinant for the polynucleotide of claim 14.

34. A host cell recombinant for the polynucleotide of claim 16.

35. A host cell recombinant for the polynucleotide of claim 18.

36. A host cell recombinant for the polynucleotide of claim 20.

37. A host cell recombinant for the polynucleotide of claim 22.

38. A host cell recombinant for the polynucleotide of claim 23.

39. A host cell recombinant for the polynucleotide of claim 26.

40. A host cell recombinant for the polynucleotide of claim 28.

* * * * *

UNITED STATES PATENT AND TRADEMARK OFFICE
CERTIFICATE OF CORRECTION

PATENT NO. : 6,555,316 B1
DATED : April 29, 2003
INVENTOR(S) : Daniel Cohen et al.

It is certified that error appears in the above-identified patent and that said Letters Patent is hereby corrected as shown below:

Column 32,
Line 60, "Publication Nos:WO96/2941 1," should read -- Publication Nos: WO96/29411, --.

Column 36,
Line 64, "D1 to D 27" should read -- D1 to D127 --.

Column 44,
Line 50, "$5x10^{-7}M$, $5x10^{-8}M$," should read -- $5x10^{-7}M$, $10^{-7}M$, $5x10^{-8}M$, --.

Column 48,
Line 14, "the $3\text{-}10^9$ base pairs" should read -- the $3x10^9$ base pairs --.

Column 53,
Line 52, "a59" should read -- A59 --.

Column 68,
Line 33, "EBS-" should read -- IBS- --.

Column 76,
Line 11, "$\theta 4$=—= frequency" should read -- $\theta 4$= - - = frequency --.
Line 13, "$\theta 3$=-+=frequency" should read -- $\theta 3$= - + = frequency --.
Line 15, "$\theta 2$=+-=frequency" should read -- $\theta 2$= + - = frequency --.
Lines 27-28, "$n_2= \Sigma$ phenotype $(a_i/a_i a_j/b_j)$" should read -- $n_2 = \Sigma$ phenotype $(a_i/a_i, a_j/b_j)$ --.

Column 84,
Line 10, "13q3 1-q33 region" should read -- 13q31-q33 region --.

Column 85,
Line 38, "an individual disease," should read -- an individual suffering from disease, --.
Line 39, "schizophrenia bipolar disorder" should read -- schizophrenia or bipolar disorder --.

Column 87,
Line 12, "A52, ASS," should read -- to A52, A55, --.

Column 105,
Line 20, "activator GALA" should read -- activator GAL4 --.

UNITED STATES PATENT AND TRADEMARK OFFICE
CERTIFICATE OF CORRECTION

PATENT NO. : 6,555,316 B1
DATED : April 29, 2003
INVENTOR(S) : Daniel Cohen et al.

It is certified that error appears in the above-identified patent and that said Letters Patent is hereby corrected as shown below:

Column 114,
Line 43, "said biallelic marker; The "nucleic acid"
should read
-- said biallelic marker
      The "nucleic acid --.

Column 145, Table 11,
Lines 52 and 53, "99-25989/398   A/G   29
                99-25993/367   A/G   44"
                                                    should read
               -- 99-25993/367   A/G   29
                 --------------------------------------
                   99-25993/367   A/G   44 --.

Column 147,
Lines 55 and 56, "the Biallelic Markers of the Invention Description
                              of Study Design"
                                                  should read
-- the Biallelic Markers of the Invention
Description of Study Design --.

Column 150, Table 15,
Lines 57 and 58,   "269, 39     99-25989/398  A/G   35, 88
                         299, 02     99-25993/367  A/G   47, 38"
                                                            should read
                       -- 269, 39     99-25989/398  A/G   35, 88
                       ----------------------------------------------------------
                         299, 02     99-25993/367  A/G   47, 38 --.

UNITED STATES PATENT AND TRADEMARK OFFICE
CERTIFICATE OF CORRECTION

PATENT NO.    : 6,555,316 B1
DATED         : April 29, 2003
INVENTOR(S)   : Daniel Cohen et al.

It is certified that error appears in the above-identified patent and that said Letters Patent is hereby corrected as shown below:

<u>Column 163,</u>
Line 2, "claim 10." should read -- claim 8. --.

Signed and Sealed this

Tenth Day of February, 2004

JON W. DUDAS
*Acting Director of the United States Patent and Trademark Office*

UNITED STATES PATENT AND TRADEMARK OFFICE
CERTIFICATE OF CORRECTION

PATENT NO. : 6,555,316 B1  Page 1 of 1
DATED : April 29, 2003
INVENTOR(S) : Daniel Cohen et al.

It is certified that error appears in the above-identified patent and that said Letters Patent is hereby corrected as shown below:

<u>Column 164,</u>
Line 6, should read:
-- 38. A host cell recombinant for the polynucleotide of claim 24. --

Signed and Sealed this

Twenty-seventh Day of April, 2004

JON W. DUDAS
*Acting Director of the United States Patent and Trademark Office*